United States Patent
Dai et al.

(10) Patent No.: US 11,932,698 B2
(45) Date of Patent: Mar. 19, 2024

(54) ANTI-MESOTHELIN CHIMERIC ANTIGEN RECEPTOR (CAR) CONSTRUCTS AND USES THEREOF

(71) Applicant: Nanjing Legend Biotech Co. Ltd., Jiangsu (CN)

(72) Inventors: Qing Dai, Nanjing (CN); Jian Liu, Nanjing (CN); Shuai Yang, Nanjing (CN); Kun Jiang, Nanjing (CN); Yuanyuan Peng, Nanjing (CN); Chen Hu, Nanjing (CN); Shu Wu, Nanjing (CN)

(73) Assignee: Nanjing Legend Biotech Co., Ltd., Nanjing (CN)

( * ) Notice: Subject to any disclaimer, the term of this patent is extended or adjusted under 35 U.S.C. 154(b) by 381 days.

(21) Appl. No.: 17/270,970

(22) PCT Filed: Aug. 29, 2019

(86) PCT No.: PCT/CN2019/103215
§ 371 (c)(1),
(2) Date: Feb. 24, 2021

(87) PCT Pub. No.: WO2020/043152
PCT Pub. Date: Mar. 5, 2020

(65) Prior Publication Data
US 2021/0269537 A1 Sep. 2, 2021

(30) Foreign Application Priority Data

Aug. 29, 2018 (WO) ............... PCT/CN2018/103050
Apr. 23, 2019 (WO) ............... PCT/CN2019/083918

(51) Int. Cl.
*C07K 16/28* (2006.01)
*A61K 35/17* (2015.01)
*A61K 38/00* (2006.01)
*A61K 39/00* (2006.01)
*A61P 35/00* (2006.01)
*C07K 14/705* (2006.01)
*C07K 14/71* (2006.01)
*C07K 14/725* (2006.01)
*C07K 16/30* (2006.01)

(52) U.S. Cl.
CPC .......... *C07K 16/2869* (2013.01); *A61K 35/17* (2013.01); *A61P 35/00* (2018.01); *C07K 14/7051* (2013.01); *C07K 14/70517* (2013.01); *C07K 14/70521* (2013.01); *C07K 14/70578* (2013.01); *C07K 14/71* (2013.01); *C07K 16/3076* (2013.01); *A61K 38/00* (2013.01); *A61K 2039/505* (2013.01); *A61K 2039/5156* (2013.01); *A61K 2039/5158* (2013.01); *C07K 2317/24* (2013.01); *C07K 2317/565* (2013.01); *C07K 2317/569* (2013.01); *C07K 2317/622* (2013.01); *C07K 2317/76* (2013.01); *C07K 2317/92* (2013.01); *C07K 2319/02* (2013.01); *C07K 2319/03* (2013.01); *C07K 2319/30* (2013.01); *C07K 2319/33* (2013.01)

(58) Field of Classification Search
CPC ............................. C07K 16/2869; A61P 35/00
See application file for complete search history.

(56) References Cited

U.S. PATENT DOCUMENTS

2018/0112003 A1* 4/2018 Epstein ............ C07K 14/70517

FOREIGN PATENT DOCUMENTS

| CN | 102875685 A | 1/2013 |
|---|---|---|
| CN | 104877032 A | 9/2015 |
| JP | 2016-500655 | 1/2016 |
| JP | 2017-534261 | 11/2017 |
| WO | 2004104041 A1 | 12/2004 |
| WO | WO 2014/004549 | 1/2014 |
| WO | WO 2014/052064 | 4/2014 |
| WO | WO 2015/090230 | 6/2015 |
| WO | WO 2015/188141 | 12/2015 |
| WO | WO 2016/044605 | 3/2016 |
| WO | 2018102795 A2 | 6/2018 |
| WO | WO 2018/132695 | 7/2018 |

OTHER PUBLICATIONS

Asgarov K,, et al., A new anti-mesothelin antibody targets selectively the membrane-associated form. MAbs. Apr. 2017;9(3):567-577. doi: 10.1080/19420862.2017.1288770. PMID: 28353419; PMCID: PMC5384705. (Year: 2017).*
McCarthy et al. (J. Immunol. Methods, 251(1-2): 137-149, 2001) (Year: 2001).*
International Search Report dated Dec. 24, 2019 in International Application No. PCT/CN2019/103215.
Hua et al., "Efficient growth suppression in pancreatic cancer PDX model by fully human anti-mesothelin CAR-T cells," Protein&Cell, Sep. 19, 2017, 8(12):926-931.
Urbanska et al., "Follicle-Stimulating Hormone Receptor as a Target in the Redirected T-cell Therapy for Cancer," Cancer Immunol Res., Jun. 25, 2015, 3(10):1130-1137.

(Continued)

*Primary Examiner* — Adam Weidner
*Assistant Examiner* — Ashley H. Gao
(74) *Attorney, Agent, or Firm* — Fish & Richardson P.C.

(57) ABSTRACT

Described herein are T cells engineered to express a chimeric antigen receptor (CAR), such as an anti-mesothelin CAR alone or in combination with a follicle-stimulating hormone receptor (FSHR) binding domain and/or a dominant negative transforming growth factor-β receptor II (dnTGFβRII) for the treatment of diseases associated with mesothelin expression. Also described are T cells engineered to express a modified T cell receptor (TCR).

24 Claims, 13 Drawing Sheets
Specification includes a Sequence Listing.

(56) References Cited

OTHER PUBLICATIONS

Perales-Puchalt et al., "Follicle-Stimulating Hormone Receptor Is Expressed by Most Ovarian Cancer Subtypes and Is a Safe and Effective Immunotherapeutic Target," Clin Cancer Res., Jul. 19, 2016, 23(2):441-453.

Kloss et al., "Dominant-Negative TGF-ß Receptor Enhances PSMATargeted Human Car T Cell Proliferation And Augments Prostate Cancer Eradication," Mol Ther., May 8, 2018, 26(7):1855-1866.

SG Search Report in Singapore Appln. No. 11202101773W, dated Oct. 11, 2022, 4 pages.

Extended European Search Report in European Appln. No. 19854280.5, dated May 2, 2022, 12 pages.

JP Office Action in Japanese Appln. No. 2021-510019, dated Jul. 11, 2023, 7 pages (with English translation).

Puchalt et al., "Follicle-Stimulating Hormone Receptor Is Expressed by Most Ovarian Cancer Subtypes and Is a Safe and Effective Immunotherapeutic Target," Clinical Cancer Research, Jan. 2017, 23(2):441-453.

\* cited by examiner

FIG. 4A
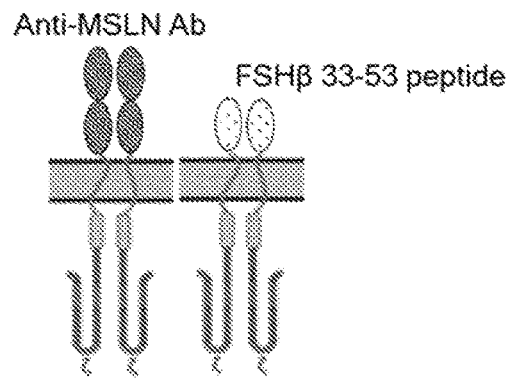
FIG. 4B
FIG. 5A
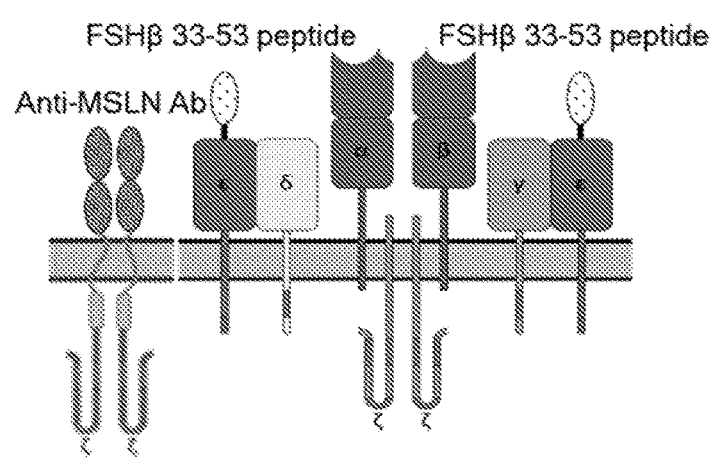
FIG. 5B

FIG. 6I
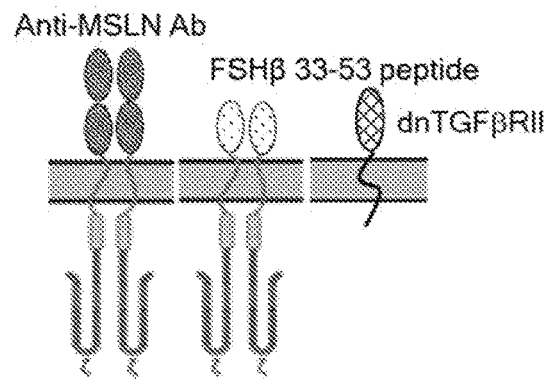
FIG. 6J
FIG. 6K
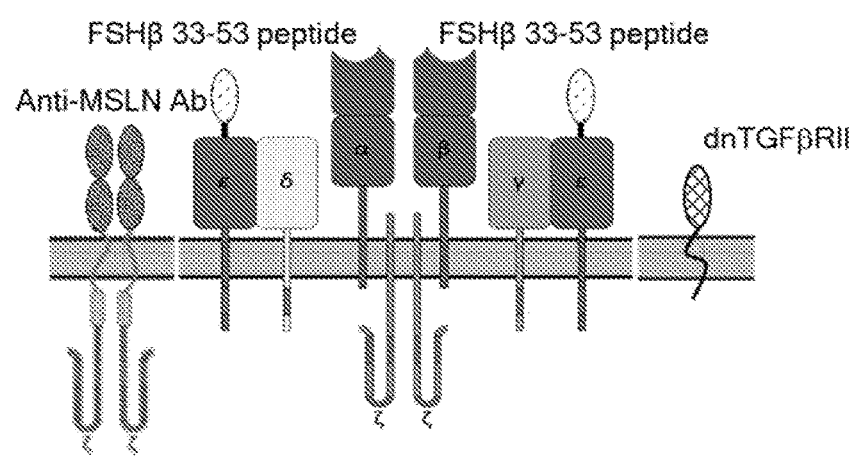
FIG. 6L

ANTI-MESOTHELIN CHIMERIC ANTIGEN RECEPTOR (CAR) CONSTRUCTS AND USES THEREOF

CROSS-REFERENCE TO RELATED APPLICATIONS

This application is a national stage of International Application No. PCT/CN2019/103215, filed on Aug. 29, 2019, which claims priority to International Patent Application No. PCT/CN2018/103050, filed on Aug. 29, 2018, and International Patent Application No. PCT/CN2019/083918, filed on Apr. 23, 2019. The disclosures of the aforementioned applications are hereby incorporated by reference in their entireties.

REFERENCE TO SEQUENCE LISTING SUBMITTED ELECTRONICALLY

This application contains a sequence listing, which is submitted electronically via EFS-Web as an ASCII formatted sequence listing with a file name "689296-13CN1 Sequence Listing" and a creation date of Apr. 16, 2019, and having a size of about 727 kb. The sequence listing submitted via EFS-Web is part of the specification and is herein incorporated by reference in its entirety.

FIELD OF THE INVENTION

The present invention generally relates to the use of T cells engineered to express chimeric antigen receptor (CAR), such as an anti-mesothelin CAR alone or in combination with a follicle-stimulating hormone receptor (FSHR) binding domain and/or a dominant negative transforming growth factor-β receptor II (dnTGFβRII) for the treatment of diseases associated with mesothelin expression.

BACKGROUND OF THE INVENTION

Adoptive T cell immunotherapy, in which a patient's own T lymphocytes are engineered to express chimeric antigen receptors (CARs), has shown great promise in treating hematological malignancies. Gill S, et al., Blood Rev. 2016; 30(3): 157-167. CARs commonly contain 3 modules: an extracellular target binding moiety, a transmembrane domain (TM domain) that anchors the CAR in the cell membrane, and an intracellular signaling domain (ICD) that transmits activation signals. Upon binding to the target tumor antigen, the CARs can activate the T cells to launch specific anti-tumor response in a major histocompatibility complexes (MHC)-independent manner.

Mesothelin (MSLN) is a tumor associated antigen originally identified by Ira Pastan and Mark Willingham at the National Cancer Institute in 1992. Chang K, et al., Cancer Res. 1992; 52(1): 181-186 and Chang K, et al., Proc Natl Acad Sci USA. 1996; 93(1): 136-140. Mesothelin is glycosylphosphatidyl inositol (GPI) anchored glycoprotein with normal expression limited to mesothelial cells lining the pleura, peritoneum, and pericardium but is overexpressed in many malignancies, including malignant pleural mesothelioma (MPM), pancreatic ductal adenocarcinoma (PDA), ovarian cancer, lung adenocarcinoma, triple negative breast cancer, endometrial cancer, biliary cancer, gastric cancer, and pediatric acute myeloid leukemia.

Mesothelin is synthesized as a 71-kD precursor protein and is the cleaved by the endoprotease furin to release the secreted N-terminal region, called megakaryocyte potentiating factor (MPF), whereas the 41-kD mature mesothelin remains attached to the membrane. Yamaguchi N, et at., Biol Chem. 1994; 269: 805-808. The remaining GPI-linked mature mesothelin can also be shed from the cell through the action of the tumor necrosis factor α-converting enzyme protease. Zhang Y, et al., Cancer Res. 2011; 71: 5915-5922.

The correlation of serum level of shed mesothelin with disease suggested a potential role for the mesothelin protein in cancer progression. While the biological function of mesothelin is not well understood. Mesothelin is known to bind to the ovarian cancer antigen MUC16 (cancer antigen 125) that has been shown to induce cell-to-cell adhesion and possibly contribute to peritoneal seeding and metastatic spread. Gubbels J A, et al., Mol Cancer. 2006; 5: 50. Furthermore, mesothelin knockout mice grow and reproduce normally and have no detectable phenotype. Bera T K, et al., Mol Cell Biol. 2000; 20: 2902-2906.

Follicle-stimulating hormone receptor (FSHR) is G protein-linked receptor found in the ovarian surface epithelium and in some ovarian cancer cell lines and tissues, its distribution may be limited in the reproductive system. Zhang W, et al., Am J Pathol. 1996; 148: 47-53. Follicle-stimulating hormone (FSH) is a glycoprotein hormone consisting of α and β chains, and amino acids 33 to 53 of the FSHβ chain has been identified to bind to FSHR with high affinity. Agris P F, et al., J Protein Chem. 1992; 11: 495-507. In particular, FSHβ 33-53 peptide appears functional when covalently attached to nanoparticles, providing high selectivity nanoparticle delivery to FSHR-expressing ovarian tumors. Zhang X Y, et al., Cancer Res. 2009; 69 (16): 6506-6514. It has been reported the expression of FSHR in 50-70% of ovarian cancer tissues, as well as its selective expression on the surface of the blood vessels of a wide range of tumors e.g., renal cell carcinoma, prostate, breast, colon, pancreas, urinary bladder, kidney, lung, liver, stomach, testis, and ovary (primary tumor and/or metastases) (Radu et al., N Engl J Med 363:1621, 2010; Siraj et al., BMC Cancer 13:246, 2013; and Renner et al., Histopathology 63:29, 2013). The relatively specific expressions of FSHR on cell surface of malignant tissues make it an attractive target for FSHR tumor immunotherapy.

Transforming growth factor-beta 1 (TGFβ1) is a multifunctional secreted protein that regulates cell proliferation, differentiation, and motility, as well as influencing production of the extracellular matrix, neovascularization and immune function. Derynck R, et al., Nature. 2003; 425: 577-584. It has been suggested that expression of TGFβ1 and its receptors (TGFβ receptor type I and TGFβ receptor type II) may play a key role in the proliferation and progression of epithelial ovarian cancer. TGFβ may also have adverse effects on tumor cells themselves by promoting terminal differentiation and apoptosis. Tumors may avoid this activity by mutation of their TGFβ receptors (TGFβRI and TGFβRII). Ebner R, et al., Science. 1993; 260: 1344-1348. Immunosuppressive milieu in many cancers attributed in part, to TGFβ signaling can be blocked by using a dominant negative TGFβRII, which is truncated and lacks the intracellular domain necessary for downstream signaling. Wieser R, et al., Molecular and cellular biology. 1993; 13: 7239-7247. A clinical trial (NCT00368082) testing the safety and efficacy of the dnTGFβRII receptor in EBV-specific T cells for lymphoma was recently reported. Bollard C M, et al., J Clin Oncol. 2018; 36: 1128-1139. More recently, another clinical trial was initiated to assess CAR-T cells directed to prostate-specific membrane antigen (PSMA) co-expressed of dnTGFβRII as an approach for patients with relapsed and refractory metastatic prostate cancer (NCT03089203). Christopher C, et al., *Molecular Therapy.* 2018; 26: 1855-1866.

T cell receptors (TCR) is a transmembrane heterodimer containing an alpha and beta chain or delta and gamma chain linked by a disulfide bond. The TCR normally contains the highly variable α and β chains expressed as part of a complex with the invariant CD3 chain molecules. The complementary determining regions (CDRs) within the α and β chains determine the antigen to which the TCR will bind, to thereby activate the T cells, leading to a plethora of immune responses. For example, antigen presenting cells (APCs) digest pathogens and display their fragments on major histocompatibility complex (MHC) molecules. This MHC/antigen complex binds to the TCR while other co-stimulatory molecules (e.g. CD28) are activated leading to T cell activation, proliferation, differentiation, apoptosis, or cytokine release (see, e.g., Samelson, 2011, *Cold Spring Harb Perspect Biol.,* 3(12): a011510). TCRs can also interact with other molecules, including non-peptide antigens such as lipids (Mori and De Libero, 2012, *Immunol Res,* 53, 191-199), metabolic intermediates bound to the MHC like molecule MR1 (Reantragoon et al. 2012, *J Exp Med,* 209: 761-774.), etc. Initiation of TCR signaling requires co-receptors such as CD4 for helper T cells and CD8 for cytotoxic T cells. These co-receptors act as cellular adhesion molecules that bind their respective MHC molecules and stabilize the interaction of T cells and antigen presenting cells. The TCR is also located in close proximity to a complex of signaling molecules, which help to mediate T cell activation. These include the CD3 family of proteins (CD3δ, CD3ε, and CD3γ) as well as a TCR zeta (ζ) chain (FIG. 1) (Wucherpfennig et al. 2010, *Cold Spring Harb Perspect Biol,* 2: a005140).

There is a need for a more targeted antigen-specific immunotherapy for treatment of certain cancers, such as, for example, ovarian cancer.

BRIEF SUMMARY OF THE INVENTION

In one general aspect, the invention relates to T cells engineered to express a chimeric antigen receptor (CAR) and uses thereof for treating certain cancers. In another general aspects, the invention relates to T cells engineered to express a modified T cell receptor (TCR) complex containing a follicle-stimulating hormone receptor (FSHR) binding domain. In certain aspects, the invention relates to T cells engineered to express an anti-mesothelin CAR in combination with a modified TCR complex containing a FSHR binding domain and/or dnTGFβRII for the treatment of diseases associated with mesothelin and/or FSHR expression. In certain aspects, the invention relates to T cells engineered to express a CAR comprising a FSHR binding domain and an antigen binding fragment that binds specifically to a tumor antigen and uses thereof. In certain aspects, the invention relates to T cells engineered to express a CAR targeting mesothelin and/or FSHR and/or a dominant negative transforming growth factor-β receptor II (dnTGFβRII) for the treatment of diseases associated with mesothelin expression.

Provided herein is an isolated polynucleotide comprising a nucleotide sequence encoding a protein of a modified T cell receptor (TCR) complex. The protein comprises, from the N-terminus to the C-terminus, a first polypeptide that binds specifically to a follicle-stimulating hormone receptor (FSHR), and an extracellular domain, a transmembrane domain and an intracellular domain of a CD3 polypeptide selected from the group consisting of a CD3-γ, CD3-δ and CD3-ε chain.

In certain embodiments, the first polypeptide that binds specifically to FSHR can, for example, comprises an amino acid sequence selected from the group consisting of SEQ ID NOs:319-331, and the protein further contains an extracellular domain comprising an amino acid sequence selected from the group consisting of SEQ ID NOs: 433 to 435, respectively; a transmembrane domain comprising an amino acid sequence selected from the group consisting of SEQ ID NOs: 436 to 438, respectively; and an intracellular domain comprising an amino acid sequence selected from the group consisting of SEQ ID NOs: 439 to 441, respectively. In certain embodiments, the protein further comprises a signal peptide. In certain embodiments, the signal peptide comprises an amino acid sequence selected from the group consisting of SEQ ID NOs: 430 to 432.

In certain embodiments, an isolated polynucleotide comprises a nucleotide sequence encoding a protein of a modified TCR complex comprising an amino acid sequence selected from the group consisting of SEQ ID NOs: 442-444.

In certain embodiments, the isolated polynucleotide further comprises a second nucleotide sequence encoding a chimeric antigen receptor (CAR), wherein the CAR comprises: (a) an extracellular domain comprising an antigen binding fragment that binds specifically to a tumor antigen; (b) a transmembrane domain; and (c) an intracellular signaling domain. The second nucleotide sequence can encode any suitable CAR. Preferably, the second nucleotide sequence encodes a CAR of the present invention, such as a CAR that binds specifically to mesothelin. Examples of the CAR include, but are not limited to, the CARs exemplified in the present application. Preferably, the nucleotide sequence encoding the protein of a modified TCR complex is connected to the nucleotide sequence encoding a CAR via a 2A peptide coding sequence.

In certain embodiments, an isolated polynucleotide comprises a nucleotide sequence encoding a protein having an amino acid sequence selected from the group consisting of SEQ ID NOs:454-456.

In certain embodiments, the nucleotide sequence encoding a protein of a modified TCR complex further comprises a third nucleotide sequence encoding a dominant negative form of an inhibitor of a cell-mediated immune response of the immune cell. The inhibitor of a cell-mediated immune response of the immune cell, can, for example, be a transforming growth factor (TGF-β) receptor. The dominant negative form of the inhibitor can, for example, comprise the amino acid sequence of SEQ ID NO:347. In certain embodiments, the nucleotide sequence encoding the protein of a modified TCR complex is connected to the third nucleotide sequence via a 2A peptide coding sequence.

In certain embodiments, an isolated polynucleotide comprises a nucleotide sequence encoding a protein having an amino acid sequence selected from the group consisting of SEQ ID NOs:457-459.

In certain embodiments, an isolated polynucleotide comprises a first nucleotide sequence encoding a protein of a modified TCR complex, a second nucleotide sequence encoding a CAR, and a third nucleotide sequence encoding a dominant negative form of an inhibitor of a cell-mediated immune response of the immune cell. In certain embodiments, the first, second and third nucleotide sequences are connected via a 2A peptide coding sequence. The first, second and third nucleotide sequences can be arranged in any order in the isolated polynucleotide.

In certain embodiments, an isolated polynucleotide comprises a nucleotide sequence encoding a protein having an amino acid sequence selected from the group consisting of SEQ ID NOs:469-471.

Also provided herein are isolated polynucleotides comprising a nucleotide sequence encoding a chimeric antigen receptor (CAR). The CAR can, for example, comprise (a) an extracellular domain comprising a first polypeptide that binds specifically to a follicle-stimulating hormone receptor (FSHR), and an antigen binding fragment that binds specifically to a tumor antigen; (b) a transmembrane domain; and (c) an intracellular signaling domain. The CAR can optionally further comprise a signal peptide at its amino terminus and a hinge region connecting the extracellular domain and the transmembrane domain.

In certain embodiments, the first polypeptide that binds specifically to a FSHR comprises an amino acid sequence selected from the group consisting of SEQ ID NOs:319-331.

In certain embodiments, the first polypeptide is connected to the amino terminus or carboxy terminus of the antigen binding fragment via a linker. The linker can, for example, be selected from the group consisting of a $G_4S$ linker, a $(G_4S)_2$ linker, a $(G_4S)_3$ linker, a $(G_4S)_4$ linker, and a $(G_4S)_5$ linker.

In certain embodiments, the tumor antigen is selected from the group consisting of mesothelin, folate receptor α, mucin 16 (MUC16), prostate-specific membrane antigen (PSMA), human epidermal growth factor receptor 2 (HER2), epidermal growth factor receptor (EGFR), and vascular endothelial growth factor receptor (VEGFR). The tumor antigen can, for example, be mesothelin, preferably human mesothelin.

In certain embodiments, the antigen binding fragment comprises a Fab, a Fab', a F(ab')₂, an Fv, a single-chain variable fragment (scFv), a minibody, a diabody, a single-domain antibody (sdAb), a light chain variable domain (VL), or a variable domain ($V_H$H) of a camelid antibody. The antigen binding fragment can, for example, comprise:
   i. a single domain antibody (sdAb) comprising a complementarity determining region 1 (CDR1), CDR2 and CDR3 having the polypeptide sequences of:
      a. SEQ ID NOs:34, 102, and 170, respectively;
      b. SEQ ID NOs:54, 122, and 190, respectively;
      c. SEQ ID NOs:55, 123, and 191, respectively;
      d. SEQ ID NOs:61, 129, and 197, respectively;
      e. SEQ ID NOs:31, 99, and 167, respectively;
      f. SEQ ID NOs:32, 100, and 168, respectively;
      g. SEQ ID NOs:33, 101, and 169, respectively;
      h. SEQ ID NOs:35, 103, and 171, respectively;
      i. SEQ ID NOs:36, 104, and 172, respectively;
      j. SEQ ID NOs:37, 105, and 173, respectively;
      k. SEQ ID NOs:38, 106, and 174, respectively;
      l. SEQ ID NOs:39, 107, and 175, respectively;
      m. SEQ ID NOs:40, 108, and 176, respectively;
      n. SEQ ID NOs:41, 109, and 177, respectively;
      o. SEQ ID NOs:42, 110, and 178, respectively;
      p. SEQ ID NOs:43, 111, and 179, respectively;
      q. SEQ ID NOs:44, 112, and 180, respectively;
      r. SEQ ID NOs:45, 113, and 181, respectively;
      s. SEQ ID NOs:46, 114, and 182, respectively;
      t. SEQ ID NOs:47, 115, and 183, respectively;
      u. SEQ ID NOs:48, 116, and 184, respectively;
      v. SEQ ID NOs:49, 117, and 185, respectively;
      w. SEQ ID NOs:50, 118, and 186, respectively;
      x. SEQ ID NOs:51, 119, and 187, respectively;
      y. SEQ ID NOs:52, 120, and 188, respectively;
      z. SEQ ID NOs:53, 121, and 189, respectively;
      aa. SEQ ID NOs:56, 124, and 192, respectively;
      bb. SEQ ID NOs:57, 125, and 193, respectively;
      cc. SEQ ID NOs:58, 126, and 194, respectively;
      dd. SEQ ID NOs:59, 127, and 195, respectively;
      ee. SEQ ID NOs:60, 128, and 196, respectively;
      ff. SEQ ID NOs:62, 130, and 198, respectively;
      gg. SEQ ID NOs:63, 131, and 199, respectively;
      hh. SEQ ID NOs:64, 132, and 200, respectively;
      ii. SEQ ID NOs:65, 133, and 201, respectively;
      jj. SEQ ID NOs:66, 134, and 202, respectively;
      kk. SEQ ID NOs:67, 135, and 203, respectively; or
      ll. SEQ ID NOs:68, 136, and 204, respectively; or
   ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
      a. SEQ ID NOs:1, 69, 137, 2, 70, and 138, respectively;
      b. SEQ ID NOs:19, 87, 155, 20, 88, and 156, respectively;
      c. SEQ ID NOs:23, 91, 159, 24, 92, and 160, respectively;
      d. SEQ ID NOs:25, 93, 161, 26, 94, and 162, respectively;
      e. SEQ ID NOs:27, 95, 163, 28, 96, and 164, respectively;
      f. SEQ ID NOs:29, 97, 165, 30, 98, and 166, respectively;
      g. SEQ ID NOs:3, 71, 139, 4, 72, and 140, respectively;
      h. SEQ ID NOs:5, 73, 141, 6, 74, and 142, respectively;
      i. SEQ ID NOs:7, 75, 143, 8, 76, and 144, respectively;
      j. SEQ ID NOs:9, 77, 145, 10, 78, and 146, respectively;
      k. SEQ ID NOs:11, 79, 147, 12, 80, and 148, respectively;
      l. SEQ ID NOs:13, 81, 149, 14, 82, and 150, respectively;
      m. SEQ ID NOs:15, 83, 151, 16, 84, and 152, respectively;
      n. SEQ ID NOs:17, 85, 153, 18, 86, and 154, respectively; or
      o. SEQ ID NOs:21, 89, 157, 22, 90, and 158, respectively, or a variant thereof comprising up to about 3 (such as about any of 1, 2, or 3) amino acid substitutions in the CDR regions.

In certain embodiments, the antigen binding fragment comprises:
   i. the single domain antibody comprising an amino acid sequence at least 95% identical to an amino acid sequence selected from the group consisting of SEQ ID NOs:221-258 and SEQ ID NOs: 420-428, or a variant thereof, preferably the variant comprises one, two, three or more amino acid substitutions, deletions and/or insertions; or
   ii. the single chain variable fragment comprising an amino acid sequence at least 95% identical to an amino acid sequence selected from the group consisting of SEQ ID NOs:205-220, or a variant thereof, preferably the variant comprises one, two, three or more amino acid substitutions, deletions and/or insertions.

In certain embodiments, the extracellular domain comprises an amino acid sequence selected from the group consisting of SEQ ID NOs:348-357 or a variant thereof, preferably the variant comprises one, two, three or more amino acid substitutions, deletions and/or insertions.

Also provided are isolated polynucleotides comprising a nucleotide sequence encoding a chimeric antigen receptor (CAR). The CAR can, for example, comprise (a) an extracellular domain comprising an antigen binding fragment that binds specifically to mesothelin, preferably human mesothelin; (b) a transmembrane domain; and (c) an intracellular signaling domain. The CAR can optionally further comprise a signal peptide at the amino terminus and a hinge region connecting the extracellular domain and the transmembrane domain. The antigen binding fragment can, for example, comprise i. a single domain antibody (sdAb) comprising a complementarity determining region 1 (CDR1), CDR2 and CDR3 having the polypeptide sequences of:
   a. SEQ ID NOs:34, 102, and 170, respectively;
   b. SEQ ID NOs:54, 122, and 190, respectively;
   c. SEQ ID NOs:55, 123, and 191, respectively;
   d. SEQ ID NOs:61, 129, and 197, respectively;
   e. SEQ ID NOs:31, 99, and 167, respectively;
   f. SEQ ID NOs:32, 100, and 168, respectively;
   g. SEQ ID NOs:33, 101, and 169, respectively;
   h. SEQ ID NOs:35, 103, and 171, respectively;
   i. SEQ ID NOs:36, 104, and 172, respectively;
   j. SEQ ID NOs:37, 105, and 173, respectively;
   k. SEQ ID NOs:38, 106, and 174, respectively;
   l. SEQ ID NOs:39, 107, and 175, respectively;
   m. SEQ ID NOs:40, 108, and 176, respectively;
   n. SEQ ID NOs:41, 109, and 177, respectively;
   o. SEQ ID NOs:42, 110, and 178, respectively;
   p. SEQ ID NOs:43, 111, and 179, respectively;
   q. SEQ ID NOs:44, 112, and 180, respectively;
   r. SEQ ID NOs:45, 113, and 181, respectively;
   s. SEQ ID NOs:46, 114, and 182, respectively;
   t. SEQ ID NOs:47, 115, and 183, respectively;
   u. SEQ ID NOs:48, 116, and 184, respectively;
   v. SEQ ID NOs:49, 117, and 185, respectively;
   w. SEQ ID NOs:50, 118, and 186, respectively;
   x. SEQ ID NOs:51, 119, and 187, respectively;
   y. SEQ ID NOs:52, 120, and 188, respectively;
   z. SEQ ID NOs:53, 121, and 189, respectively;
   aa. SEQ ID NOs:56, 124, and 192, respectively;
   bb. SEQ ID NOs:57, 125, and 193, respectively;
   cc. SEQ ID NOs:58, 126, and 194, respectively;
   dd. SEQ ID NOs:59, 127, and 195, respectively;
   ee. SEQ ID NOs:60, 128, and 196, respectively;
   ff. SEQ ID NOs:62, 130, and 198, respectively;
   gg. SEQ ID NOs:63, 131, and 199, respectively;
   hh. SEQ ID NOs:64, 132, and 200, respectively;
   ii. SEQ ID NOs:65, 133, and 201, respectively;
   jj. SEQ ID NOs:66, 134, and 202, respectively;
   kk. SEQ ID NOs:67, 135, and 203, respectively; or
   ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
   a. SEQ ID NOs:1, 69, 137, 2, 70, and 138, respectively;
   b. SEQ ID NOs:19, 87, 155, 20, 88, and 156, respectively;
   c. SEQ ID NOs:23, 91, 159, 24, 92, and 160, respectively;
   d. SEQ ID NOs:25, 93, 161, 26, 94, and 162, respectively;
   e. SEQ ID NOs:27, 95, 163, 28, 96, and 164, respectively;
   f. SEQ ID NOs:29, 97, 165, 30, 98, and 166, respectively;
   g. SEQ ID NOs:3, 71, 139, 4, 72, and 140, respectively;
   h. SEQ ID NOs:5, 73, 141, 6, 74, and 142, respectively;
   i. SEQ ID NOs:7, 75, 143, 8, 76, and 144, respectively;
   j. SEQ ID NOs:9, 77, 145, 10, 78, and 146, respectively;
   k. SEQ ID NOs:11, 79, 147, 12, 80, and 148, respectively;
   l. SEQ ID NOs:13, 81, 149, 14, 82, and 150, respectively;
   m. SEQ ID NOs:15, 83, 151, 16, 84, and 152, respectively;
   n. SEQ ID NOs:17, 85, 153, 18, 86, and 154, respectively; or
   o. SEQ ID NOs:21, 89, 157, 22, 90, and 158, respectively,
or a variant thereof comprising up to about 3 (such as about any of 1, 2, or 3) amino acid substitutions in the CDR regions.

In certain embodiments, the antigen binding fragment comprises:
  i. the single domain antibody comprising an amino acid sequence at least 95% identical to an amino acid sequence selected from the group consisting of SEQ ID NOs:221-258 and 420-428, or a variant thereof, preferably the variant comprises one, two or three amino acid substitutions, deletions or insertions, or
  ii. the single chain variable fragment comprising an amino acid sequence at least 95% identical to an amino acid sequence selected from the group consisting of SEQ ID NOs:205-220, a variant thereof, preferably the variant comprises one, two or three amino acid substitutions, deletions or insertions.

In certain embodiments, the polynucleotide further comprises a second nucleotide sequence encoding a second chimeric antigen receptor (CAR), wherein the second CAR comprises:
  (a) an extracellular domain comprising a polypeptide that binds specifically to a follicle-stimulating hormone receptor (FSHR);
  (b) a transmembrane domain; and
  (c) an intracellular signaling domain,
wherein the second CAR optionally further comprises a signal peptide at the amino terminus and a hinge region connecting the extracellular domain and the transmembrane domain.

Preferably, the nucleotide sequence encoding the CAR is connected to the second nucleotide sequence via a 2A peptide coding sequence.

The polypeptide that binds specifically to the FSHR can, for example, comprise an amino acid sequence selected from the group consisting of SEQ ID NOs:319-331.

In certain embodiments, the CAR comprises a signal peptide having an amino acid sequence that is at least 90% identical to SEQ ID NO:340. In certain embodiments, the CAR comprises a hinge region having an amino acid sequence that is at least 90% identical to SEQ ID NO:341.

In certain embodiments, the CAR comprises a transmembrane domain selected from the group consisting of a CD8α transmembrane domain, a CD28 transmembrane domain, a CD4 transmembrane domain, a CD3ζ transmembrane domain, a CD2 transmembrane domain, a 4-1BB transmembrane domain, an OX40 transmembrane domain, an ICOS transmembrane domain, a CTLA-4 transmembrane domain, a PD-1 transmembrane domain, a LAG-3 transmembrane domain, a 2B4 transmembrane domain, a BTLA transmembrane domain, and a GMCSFR transmembrane domain.

In certain embodiments, the CAR comprises an intracellular signaling domain selected from the group consisting of a signaling domain of CD3ζ, FcRγ, FcRβ, CD3γ, CD3δ, CD3ε, CD5, CD22, CD79α, CD79β, and CD66δ.

In certain embodiments, the CAR comprises a co-stimulatory domain selected from the group consisting of a co-stimulatory domain of one or more of CD28, 4-1BB (CD137), CD27, OX40, CD27, CD40, PD-1, ICOS, lymphocyte function-associated antigen-1 (LFA-1), CD2, CD7, LIGHT, NKG2C, B7-H3, TNFRSF9, TNFRSF4, TNFRSF8, CD40LG, ITGB2, KLRC2, TNFRSF18, TNFRSF14, HAVCR1, LGALS9, CD83, and a ligand that specifically binds with CD83.

In certain embodiments, an isolated polynucleotide comprises a nucleotide sequence encoding a CAR comprising an amino acid sequence selected from the group consisting of SEQ ID NOs:370-379 and SEQ ID NOs: 448-450.

In certain embodiments, an isolated polynucleotide comprises a nucleotide sequence encoding an amino acid sequence selected from the group consisting of SEQ ID NOs:380-389 and SEQ ID NOs:451-453.

In certain embodiments, an isolated polynucleotide comprises a nucleotide sequence encoding a CAR comprising an amino acid sequence selected from the group consisting of SEQ ID NOs:358-367 and SEQ ID NOs:445-447.

In certain embodiments, the nucleotide sequence encoding the CAR further comprises a third nucleotide sequence encoding a dominant negative form of an inhibitor of a cell-mediated immune response of the immune cell. The inhibitor of a cell-mediated immune response of the immune cell, can, for example, be a transforming growth factor β (TGF-β) receptor. The dominant negative form of the inhibitor can, for example, comprise the amino acid sequence of SEQ ID NO:347. In certain embodiments, the nucleotide sequence encoding the CAR is connected to the third nucleotide sequence via a 2A peptide coding sequence.

In certain embodiments, an isolated polynucleotide comprises a nucleotide sequence encoding an amino acid sequence selected from the group consisting of SEQ ID NOs:390-419 and SEQ ID NOs:460-468.

Also provided are vectors comprising the polynucleotides of the invention.

Also provided are host cells comprising the polynucleotides of the invention or the vectors of the invention.

Also provided are engineered immune cells expressing a CAR encoded by a polynucleotide of the invention. The engineered immune cell can, for example, be selected from the group consisting of a cytotoxic T cell, a helper T cell, a natural killer T cell, a γδT cell, and a NK cell.

Also provided are pharmaceutical compositions. The pharmaceutical compositions can comprise a polynucleotide of the invention, a vector of the invention, a host cell of the invention, and/or an engineered immune cell of the invention and a pharmaceutically acceptable carrier.

Also provided are methods of treating a cancer in a subject in need thereof. The methods can, for example, comprise to the subject a therapeutically effective amount of the host cells of the invention. The methods can, for example, comprise administering to the subject a therapeutically effective amount of the pharmaceutical composition of the invention. In certain embodiments, the cancer is selected from the group consisting of an ovarian cancer, primary peritoneal carcinomas, pancreatic ductal adenocarcinoma (PDA), malignant pleural mesothelioma (MPM), lung adenocarcinoma, triple negative breast cancer, endometrial cancer, biliary cancer, gastric cancer, and pediatric acute myeloid leukemia.

Also provided are methods of engineering an immune cell. The methods comprise introducing into the immune cell a polynucleotide of the invention, wherein the polynucleotide is operably linked to a promoter.

Also provided are methods of producing a pharmaceutical composition. The methods comprise combining a polynucleotide of the invention, a vector of the invention, a host cell of the invention, and/or an engineered immune cell of the invention with a pharmaceutically acceptable carrier to obtain the pharmaceutical composition.

Also provided are systems for inducing the activity of an immune cell and/or a target cell. The systems can, for example, comprise a chimeric antigen receptor (CAR) of the invention.

Also provided are isolated antibodies or antigen binding fragments that specifically bind mesothelin, preferably human mesothelin. The isolated antibodies or antigen binding fragments can, for example, be selected from the group consisting of a Fab, a Fab', a F(ab')$_2$, an Fv, a single-chain variable fragment (scFv), a minibody, a diabody, a single-domain antibody (sdAb), a light chain variable domain (VL), and a variable domain (V$_H$H) of a camelid antibody.

In certain embodiments, the isolated antibody or antigen binding fragment comprises:

i. a single domain antibody (sdAb) comprising a complementarity determining region 1 (CDR1), CDR2 and CDR3 having the polypeptide sequences of:
   a. SEQ ID NOs:34, 102, and 170, respectively;
   b. SEQ ID NOs:54, 122, and 190, respectively;
   c. SEQ ID NOs:55, 123, and 191, respectively;
   d. SEQ ID NOs:61, 129, and 197, respectively;
   e. SEQ ID NOs:31, 99, and 167, respectively;
   f. SEQ ID NOs:32, 100, and 168, respectively;
   g. SEQ ID NOs:33, 101, and 169, respectively;
   h. SEQ ID NOs:35, 103, and 171, respectively;
   i. SEQ ID NOs:36, 104, and 172, respectively;
   j. SEQ ID NOs:37, 105, and 173, respectively;
   k. SEQ ID NOs:38, 106, and 174, respectively;
   l. SEQ ID NOs:39, 107, and 175, respectively;
   m. SEQ ID NOs:40, 108, and 176, respectively;
   n. SEQ ID NOs:41, 109, and 177, respectively;
   o. SEQ ID NOs:42, 110, and 178, respectively;
   p. SEQ ID NOs:43, 111, and 179, respectively;
   q. SEQ ID NOs:44, 112, and 180, respectively;
   r. SEQ ID NOs:45, 113, and 181, respectively;
   s. SEQ ID NOs:46, 114, and 182, respectively;
   t. SEQ ID NOs:47, 115, and 183, respectively;
   u. SEQ ID NOs:48, 116, and 184, respectively;
   v. SEQ ID NOs:49, 117, and 185, respectively;
   w. SEQ ID NOs:50, 118, and 186, respectively;
   x. SEQ ID NOs:51, 119, and 187, respectively;
   y. SEQ ID NOs:52, 120, and 188, respectively;
   z. SEQ ID NOs:53, 121, and 189, respectively;
   aa. SEQ ID NOs:56, 124, and 192, respectively;
   bb. SEQ ID NOs:57, 125, and 193, respectively;
   cc. SEQ ID NOs:58, 126, and 194, respectively;
   dd. SEQ ID NOs:59, 127, and 195, respectively;
   ee. SEQ ID NOs:60, 128, and 196, respectively;
   ff. SEQ ID NOs:62, 130, and 198, respectively;
   gg. SEQ ID NOs:63, 131, and 199, respectively;
   hh. SEQ ID NOs:64, 132, and 200, respectively;
   ii. SEQ ID NOs:65, 133, and 201, respectively;
   jj. SEQ ID NOs:66, 134, and 202, respectively;

kk. SEQ ID NOs:67, 135, and 203, respectively; or
ll. SEQ ID NOs:68, 136, and 204, respectively; or
ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
   a. SEQ ID NOs:1, 69, 137, 2, 70, and 138, respectively;
   b. SEQ ID NOs:19, 87, 155, 20, 88, and 156, respectively;
   c. SEQ ID NOs:23, 91, 159, 24, 92, and 160, respectively;
   d. SEQ ID NOs:25, 93, 161, 26, 94, and 162, respectively;
   e. SEQ ID NOs:27, 95, 163, 28, 96, and 164, respectively;
   f. SEQ ID NOs:29, 97, 165, 30, 98, and 166, respectively;
   g. SEQ ID NOs:3, 71, 139, 4, 72, and 140, respectively;
   h. SEQ ID NOs:5, 73, 141, 6, 74, and 142, respectively;
   i. SEQ ID NOs:7, 75, 143, 8, 76, and 144, respectively;
   j. SEQ ID NOs:9, 77, 145, 10, 78, and 146, respectively;
   k. SEQ ID NOs:11, 79, 147, 12, 80, and 148, respectively;
   l. SEQ ID NOs:13, 81, 149, 14, 82, and 150, respectively;
   m. SEQ ID NOs:15, 83, 151, 16, 84, and 152, respectively;
   n. SEQ ID NOs:17, 85, 153, 18, 86, and 154, respectively; or
   o. SEQ ID NOs:21, 89, 157, 22, 90, and 158, respectively; or
a variant thereof comprising up to about 3 (such as about any of 1, 2, or 3) amino acid substitutions in the CDR regions; wherein the isolated antibody or antigen binding fragment thereof specifically binds mesothelin, preferably human mesothelin.

In certain embodiments, the antibody or antigen binding fragment comprises:
i. the single domain antibody comprising an amino acid sequence at least 95% identical to an amino acid sequence selected from the group consisting of SEQ ID NOs:221-258 and 420-428, or a variant thereof, preferably the variant comprises one, two, three or more amino acid substitutions, deletions and/or insertions; or
ii. the single chain variable fragment comprising an amino acid sequence at least 95% identical to an amino acid sequence selected from the group consisting of SEQ ID NOs:205-220, or a variant thereof, preferably the variant comprises one, two, three or more amino acid substitutions, deletions and/or insertions.

In certain embodiments, the antibody or antigen binding fragment thereof is chimeric. In certain embodiments, the antibody or antigen binding fragment thereof is human or humanized.

Also provided are isolated nucleic acids encoding the isolated antibody or antigen binding fragment thereof of the invention. Also provided are vectors comprising the isolated nucleic acids of the invention. Also provided are host cells comprising the isolated nucleic acids and/or the vectors of the invention.

Also provided are pharmaceutical compositions comprising the isolated antibody or antigen binding fragment thereof of the invention and a pharmaceutically acceptable carrier.

Also provided are methods of treating a cancer in a subject in need thereof. The methods comprise administering to the subject a pharmaceutical composition comprising the isolated antibody or antigen binding fragment thereof of the invention and a pharmaceutically acceptable carrier.

Also provided are methods of producing the antibody or antigen binding fragment thereof of the invention. The methods comprise culturing a cell comprising a nucleic acid encoding the antibody or antigen binding fragment thereof under conditions to produce the antibody or antigen binding fragment thereof, and recovering the antibody or antigen binding fragment thereof from the cell or culture.

Also provided are methods of producing a pharmaceutical composition comprising the antibody or antigen binding fragment thereof of the invention. The methods comprise combining the antibody or antigen binding fragment thereof with a pharmaceutically acceptable carrier to obtain the pharmaceutical composition.

BRIEF DESCRIPTION OF THE DRAWINGS

The foregoing summary, as well as the following detailed description of preferred embodiments of the present application, will be better understood when read in conjunction with the appended drawings. It should be understood, however, that the application is not limited to the precise embodiments shown in the drawings.

FIGS. 4A-4B show schematic representations of a mesothelin/FSHR dual CAR construct and an illustration of the construct anchored in T cell membrane.

FIGS. 5A-5B show schematic representations of a mesothelin/FSHR CAR/TCR construct and an illustration of the construct anchored in T cell membrane.

FIGS. 6A-6L show schematic representations of a dnTGFβRII armored CAR and/or TCR constructs according to embodiments of the application and illustrations of the constructs anchored in T cell membrane.

DETAILED DESCRIPTION OF THE INVENTION

Figure 1A:
FIG. 1A is a schematic representation of an anti-mesothelin CAR construct.

Various publications, articles and patents are cited or described in the background and throughout the specification; each of these references is herein incorporated by reference in its entirety. Discussion of documents, acts, materials, devices, articles or the like which has been included in the present specification is for the purpose of providing context for the invention. Such discussion is not an admission that any or all of these matters form part of the prior art with respect to any inventions disclosed or claimed.

Unless defined otherwise, all technical and scientific terms used herein have the same meaning as commonly understood to one of ordinary skill in the art to which this invention pertains. Otherwise, certain terms used herein have the meanings as set forth in the specification.

It must be noted that as used herein and in the appended claims, the singular forms "a," "an," and "the" include plural reference unless the context clearly dictates otherwise.

Unless otherwise stated, any numerical values, such as a concentration or a concentration range described herein, are to be understood as being modified in all instances by the term "about." Thus, a numerical value typically includes ±10% of the recited value. For example, a concentration of 1 mg/mL includes 0.9 mg/mL to 1.1 mg/mL. Likewise, a concentration range of 1% to 10% (w/v) includes 0.9% (w/v) to 11% (w/v). As used herein, the use of a numerical range expressly includes all possible subranges, all individual numerical values within that range, including integers within such ranges and fractions of the values unless the context clearly indicates otherwise.

Unless otherwise indicated, the term "at least" preceding a series of elements is to be understood to refer to every element in the series. Those skilled in the art will recognize or be able to ascertain using no more than routine experimentation, many equivalents to the specific embodiments of the invention described herein. Such equivalents are intended to be encompassed by the invention.

As used herein, the terms "comprises," "comprising," "includes," "including," "has," "having," "contains" or "containing," or any other variation thereof, will be understood to imply the inclusion of a stated integer or group of integers but not the exclusion of any other integer or group of integers and are intended to be non-exclusive or open-ended. For example, a composition, a mixture, a process, a method, an article, or an apparatus that comprises a list of elements is not necessarily limited to only those elements but can include other elements not expressly listed or inherent to such composition, mixture, process, method, article, or apparatus. Further, unless expressly stated to the contrary, "or" refers to an inclusive or and not to an exclusive or. For example, a condition A or B is satisfied by any one of the following: A is true (or present) and B is false (or not present), A is false (or not present) and B is true (or present), and both A and B are true (or present).

As used herein, the conjunctive term "and/or" between multiple recited elements is understood as encompassing both individual and combined options. For instance, where two elements are conjoined by "and/or," a first option refers to the applicability of the first element without the second. A second option refers to the applicability of the second element without the first. A third option refers to the applicability of the first and second elements together. Any one of these options is understood to fall within the meaning, and therefore satisfy the requirement of the term "and/or" as used herein. Concurrent applicability of more than one of the options is also understood to fall within the meaning, and therefore satisfy the requirement of the term "and/or."

As used herein, the term "consists of," or variations such as "consist of" or "consisting of," as used throughout the specification and claims, indicate the inclusion of any recited integer or group of integers, but that no additional integer or group of integers can be added to the specified method, structure, or composition.

As used herein, the term "consists essentially of," or variations such as "consist essentially of" or "consisting essentially of," as used throughout the specification and claims, indicate the inclusion of any recited integer or group of integers, and the optional inclusion of any recited integer or group of integers that do not materially change the basic or novel properties of the specified method, structure or composition. See M.P.E.P. § 2111.03.

As used herein, "subject" means any animal, preferably a mammal, most preferably a human. The term "mammal" as used herein, encompasses any mammal Examples of mammals include, but are not limited to, cows, horses, sheep, pigs, cats, dogs, mice, rats, rabbits, guinea pigs, monkeys, humans, etc., more preferably a human.

It should also be understood that the terms "about," "approximately," "generally," "substantially," and like terms, used herein when referring to a dimension or characteristic of a component of the preferred invention, indicate that the described dimension/characteristic is not a strict boundary or parameter and does not exclude minor variations therefrom that are functionally the same or similar, as would be understood by one having ordinary skill in the art. At a minimum, such references that include a numerical parameter would include variations that, using mathematical and industrial principles accepted in the art (e.g., rounding, measurement or other systematic errors, manufacturing tolerances, etc.), would not vary the least significant digit.

The terms "identical" or percent "identity," in the context of two or more nucleic acids or polypeptide sequences (e.g., CAR polypeptides and the CAR polynucleotides encoding them; anti-mesothelin antibody and antigen binding fragments thereof and the polynucleotides that encode them; FSHR peptides and the polynucleotides that encode them; dnTGFβRII peptides and the polynucleotides that encode them), refer to two or more sequences or subsequences that are the same or have a specified percentage of amino acid residues or nucleotides that are the same, when compared and aligned for maximum correspondence, as measured using one of the following sequence comparison algorithms or by visual inspection.

For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally, *Current Protocols in Molecular Biology*, F. M. Ausubel et al., eds., Current Protocols, a joint venture between Greene Publishing Associates, Inc. and John Wiley & Sons, Inc., (1995 Supplement) (Ausubel)).

Examples of algorithms that are suitable for determining percent sequence identity and sequence similarity are the BLAST and BLAST 2.0 algorithms, which are described in Altschul et al. (1990) *J. Mol. Biol.* 215: 403-410 and Altschul et al. (1997) *Nucleic Acids Res.* 25: 3389-3402, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased.

Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff, *Proc. Natl. Acad. Sci. USA* 89:10915 (1989)).

In addition to calculating percent sequence identity, the BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, more preferably less than about 0.01, and most preferably less than about 0.001.

A further indication that two nucleic acid sequences or polypeptides are substantially identical is that the polypeptide encoded by the first nucleic acid is immunologically cross reactive with the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules hybridize to each other under stringent conditions.

As used herein, the term "isolated" means a biological component (such as a nucleic acid, peptide or protein) has been substantially separated, produced apart from, or purified away from other biological components of the organism in which the component naturally occurs, i.e., other chromosomal and extrachromosomal DNA and RNA, and proteins. Nucleic acids, peptides and proteins that have been "isolated" thus include nucleic acids and proteins purified by standard purification methods. "Isolated" nucleic acids, peptides and proteins can be part of a composition and still be isolated if the composition is not part of the native environment of the nucleic acid, peptide, or protein. The term also embraces nucleic acids, peptides and proteins prepared by recombinant expression in a host cell as well as chemically synthesized nucleic acids.

As used herein, the term "polynucleotide," synonymously referred to as "nucleic acid molecule," "nucleotides" or "nucleic acids," refers to any polyribonucleotide or polydeoxyribonucleotide, which can be unmodified RNA or DNA or modified RNA or DNA. "Polynucleotides" include, without limitation single- and double-stranded DNA, DNA that is a mixture of single- and double-stranded regions, single- and double-stranded RNA, and RNA that is mixture of single- and double-stranded regions, hybrid molecules comprising DNA and RNA that can be single-stranded or, more typically, double-stranded or a mixture of single- and double-stranded regions. In addition, "polynucleotide" refers to triple-stranded regions comprising RNA or DNA or both RNA and DNA. The term polynucleotide also includes DNAs or RNAs containing one or more modified bases and DNAs or RNAs with backbones modified for stability or for other reasons. "Modified" bases include, for example, tritylated bases and unusual bases such as inosine. A variety of modifications can be made to DNA and RNA; thus, "polynucleotide" embraces chemically, enzymatically or metabolically modified forms of polynucleotides as typically found in nature, as well as the chemical forms of DNA and RNA characteristic of viruses and cells. "Polynucleotide" also embraces relatively short nucleic acid chains, often referred to as oligonucleotides.

As used herein, the term "vector" is a replicon in which another nucleic acid segment can be operably inserted so as to bring about the replication or expression of the segment.

As used herein, the term "host cell" refers to a cell comprising a nucleic acid molecule of the invention. The "host cell" can be any type of cell, e.g., a primary cell, a cell in culture, or a cell from a cell line. In one embodiment, a "host cell" is a cell transfected with a nucleic acid molecule of the invention. In another embodiment, a "host cell" is a progeny or potential progeny of such a transfected cell. A progeny of a cell may or may not be identical to the parent cell, e.g., due to mutations or environmental influences that can occur in succeeding generations or integration of the nucleic acid molecule into the host cell genome.

The term "expression" as used herein, refers to the biosynthesis of a gene product. The term encompasses the transcription of a gene into RNA. The term also encompasses translation of RNA into one or more polypeptides, and further encompasses all naturally occurring post-transcriptional and post-translational modifications. The expressed CAR can be within the cytoplasm of a host cell, into the extracellular milieu such as the growth medium of a cell culture, or anchored to the cell membrane.

As used herein, the term "immune cell" or "immune effector cell" refers to a cell that is involved in an immune response, e.g., in the promotion of an immune effector response. Examples of immune cells include T cells, B cells, natural killer (NK) cells, mast cells, and myeloid-derived phagocytes. According to particular embodiments, the engineered immune cells are T cells, and are referred to as CAR-T cells because they are engineered to express CARs of the invention.

As used herein, the term "engineered immune cell" refers to an immune cell, also referred to as an immune effector cell, which has been genetically modified by the addition of extra genetic material in the form of DNA or RNA to the total genetic material of the cell. According to embodiments herein, the engineered immune cells have been genetically modified to express a CAR construct according to the invention.

As used herein, the term "signal peptide" refers to a leader sequence at the amino-terminus (N-terminus) of a nascent protein, which co-translationally or post-translationally directs the nascent protein to the endoplasmic reticulum and subsequent surface expression.

As used herein, the term "extracellular antigen binding domain," "extracellular domain," or "extracellular ligand binding domain" refers to the part of a protein that is located outside of the cell membrane and is capable of binding to an antigen, target or ligand.

As used herein, the term "hinge region" refers to the part of a protein that connects two adjacent domains of the protein, e.g., the extracellular domain and the transmembrane domain.

As used herein, the term "transmembrane domain" refers to the portion of a protein that extends across the cell membrane and anchors the protein to cell membrane.

T Cell Receptors (TCRs) Complex and Chimeric Antigen Receptors (CARs)

TCRs are disulfide-linked membrane anchored heterodimeric proteins, typically comprising highly variable alpha (α) and beta (β) chains expressed as a complex with invariant CD3 chain molecules. T cells expressing these type of TCRs are referred to as α:β (or αβ) T cells. A minority of T cells express an alternative TCR comprising variable gamma (γ) and delta (δ) chains and are referred to as γδ T cells. TCR is not able to mediate signal transduction itself due to its short cytoplasmic tail, so TCR still requires CD3 and zeta to carry out the signal transduction in its place. A TCR receptor complex is an octomeric complex of variable TCR receptor α and β chains with three dimeric signaling modules CD3δ/ε, CD3γ/ε and CD247 ζ/ζ or ζ/η.

According to embodiments of the application, suitable TCRs bind specifically to a major histocompatibility complex (MHC) on the surface of cancer cells that displays a peptide fragment of a tumor antigen. An MHC is a set of cell-surface proteins which allow the acquired immune system to recognize 'foreign' molecules. Proteins are intracellularly degraded and presented on the surface of cells by the MHC. MHCs displaying "foreign" peptides, such a viral or cancer associated peptides, are recognized by T cells with the appropriate TCRs, prompting cell destruction pathways. MHCs on the surface of cancer cells can display peptide fragments of tumor antigen i.e. an antigen which is present on a cancer cell but not the corresponding non-cancerous cell. T cells which recognize these peptide fragments can exert a cytotoxic effect on the cancer cell.

For example, the T cells can be modified to express a heterologous TCR that binds specifically to MHCs displaying peptide fragments of a tumor antigen expressed by the cancer cells in a specific cancer patient. Tumor antigens expressed by cancer cells in the cancer patient may identified using standard techniques. According to an embodiment of the invention, the heterologous TCR binds specifically to FSHR. For example, a polypeptide, such as an FSH fragment, which binds specifically to an FSHR, is fused to CD3 epsilon, CD3 gamma or CD3 delta chain. The fusion protein forms a TCR complex on T cells through the interaction of CD3 with TCR α/β chains. The TCR complex binds specifically to FSHR on tumor cells via the FSH fragment, and the binding initiates TCR signaling against the tumor cells. According to yet another embodiment of the invention, the heterologous TCR is expressed together with a CAR that binds specifically to mesothelin. Heterologous TCRs can include αβTCR heterodimers.

The TCR can be engineered to increase its affinity or avidity for a tumor antigen (i.e. an affinity enhanced TCR). The affinity enhanced TCR can comprise one or more mutations relative to a naturally occurring TCR, for example, one or more mutations in the hypervariable complementarity determining regions (CDRs) of the variable regions of the TCR α and β chains. These mutations increase the affinity of the TCR for MHCs that display a peptide fragment of a tumor antigen expressed by cancer cells. Suitable methods of generated affinity enhanced TCRs include screening libraries of TCR mutants using phage or yeast display and are well known in the art (see for example Robbins et al J Immunol (2008) 180(9):6116; San Miguel et al (2015) Cancer Cell 28 (3) 281-283; Schmitt et al (2013) Blood 122 348-256; Jiang et al (2015) Cancer Discovery 5 901).

Expression of a heterologous antigen receptor, such as a heterologous TCR or CAR, can alter the immunogenic specificity of the T cells so that they recognize or display improved recognition for one or more tumor antigens that are present on the surface of the cancer cells of an individual with cancer.

In some embodiments, the T cells can display reduced binding or no binding to cancer cells in the absence of the heterologous antigen receptor. For example, expression of the heterologous antigen receptor (such as the engineered CAR and/or TCR) can increase the affinity and/or specificity of the cancer cell binding of modified T cells relative to unmodified T cells.

In some embodiments, the coding sequences for the individual components of the CAR and/or TCR (e.g. scFv or sdAb, FSH fragment, CD3 epsilon, CD3 gamma or CD3 delta chain, or TCRα and TCRβ chains) can be separated by a sequence encoding a cleavage recognition sequence. This allows the components of the construct to be expressed as a single fusion which undergoes intracellular cleavage to generate the two or more separate proteins. Suitable cleavage recognition sequences are well known in the art and include, but are not limited to, 2A-furin sequence, e.g., P2A.

The term "heterologous" refers to a polypeptide or nucleic acid that is foreign to a particular biological system, such as a host cell, and is not naturally present in that system. A heterologous polypeptide or nucleic acid can be introduced to a biological system by artificial means, for example using recombinant techniques. For example, heterologous nucleic acid encoding a polypeptide can be inserted into a suitable expression construct which is in turn used to transform a host cell to produce the polypeptide. A heterologous polypeptide or nucleic acid can be synthetic or artificial or may exist in a different biological system, such as a different species or cell type. An endogenous polypeptide or nucleic acid is native to a particular biological system, such as a host cell, and is naturally present in that system. A recombinant polypeptide is expressed from heterologous nucleic acid that has been introduced into a cell by artificial means, for example using recombinant techniques. A recombinant polypeptide can be identical to a polypeptide that is naturally present in the cell or can be different from the polypeptides that are naturally present in that cell.

In one general aspect, provided is an isolated polynucleotide comprising a nucleotide sequence encoding a protein of a modified T cell receptor (TCR) complex. The protein comprises, from the N-terminus to the C-terminus, an optional signal peptide, a first polypeptide that binds specifically to a follicle-stimulating hormone receptor (FSHR), and an extracellular domain, a transmembrane domain and an intracellular domain of a CD3 polypeptide selected from the group consisting of a CD3-γ, CD3-δ and CD3-ε chain.

In certain embodiments, the protein contains a signal peptide comprising an amino acid sequence selected from the group consisting of an amino acid sequence at least 90% identical to SEQ ID NOs: 430 to 432, respectively; a first polypeptide that binds specifically to FSHR comprising an amino acid sequence selected from the group consisting of an amino acid sequence at least 90% identical to SEQ ID NOs:319-331, respectively; an extracellular domain comprising an amino acid sequence selected from the group consisting of an amino acid sequence at least 90% identical to SEQ ID NOs: 433 to 435, respectively; a transmembrane domain comprising an amino acid sequence selected from the group consisting of an amino acid sequence at least 90% identical to SEQ ID NOs: 436 to 438, respectively; and an intracellular domain comprising an amino acid sequence selected from the group consisting of an amino acid sequence at least 90% identical to SEQ ID NOs: 439 to 441, respectively.

In certain embodiments, the protein contains a signal peptide comprising an amino acid sequence selected from the group consisting of SEQ ID NOs: 430 to 432; a first polypeptide that binds specifically to FSHR comprising an amino acid sequence selected from the group consisting of SEQ ID NOs:319-331; an extracellular domain comprising an amino acid sequence selected from the group consisting of SEQ ID NOs: 433 to 435, respectively; a transmembrane domain comprising an amino acid sequence selected from the group consisting of SEQ ID NOs: 436 to 438, respectively; and an intracellular domain comprising an amino acid sequence selected from the group consisting of SEQ ID NOs: 439 to 441, respectively.

In certain embodiments, an isolated polynucleotide comprises a nucleotide sequence encoding a protein of a modified TCR complex comprising the amino acid sequence of SEQ ID NO: 442-444, or a variant thereof. Preferably, the variant comprises one, two, three or more amino acid substitutions, deletions and/or insertions.

In certain embodiments, the isolated polynucleotide comprising the nucleotide sequence encoding a protein of a modified TCR further comprises a third nucleotide sequence encoding a dominant negative form of an inhibitor of the cell-mediated immune response of the immune cell. The inhibitor of a cell-mediated immune response of the immune cell can, for example, be a transforming growth factor β (TGF-β) receptor (e.g., TGFβRII). In certain embodiments, the dominant negative form of the inhibitor comprises the amino acid sequence of SEQ ID NO:347. In certain embodiments, the nucleotide sequence encoding the protein of a modified TCR complex is connected to the third nucleotide sequence via a 2A peptide coding sequence.

In certain embodiments, an isolated polynucleotide comprising a nucleotide sequence encoding a protein that is subsequently cleaved to product a protein of a modified TCR and a dominant negative form of an inhibitor of the cell-mediated immune response of the immune cell. Preferably, the protein comprises an amino acid sequence selected from the group consisting of SEQ ID NOs:457-459.

In certain embodiments, the isolated polynucleotide encoding a protein of a modified TCR further comprises a second nucleotide sequence encoding a chimeric antigen receptor (CAR), wherein the CAR comprises: (a) an extracellular domain comprising an antigen binding fragment that binds specifically to a tumor antigen; (b) a transmembrane domain; and (c) an intracellular signaling domain. Preferably, the nucleotide sequence encoding the protein of a modified TCR complex is connected to the nucleotide sequence encoding a CAR via a 2A peptide coding sequence.

In certain embodiments, an isolated polynucleotide comprising a nucleotide sequence encoding a protein that is subsequently cleaved to product a protein of a modified TCR and CAR. Preferably, the protein comprises an amino acid sequence selected from the group consisting of SEQ ID NOs:454-456.

In certain embodiments, an isolated polynucleotide comprising a nucleotide sequence encoding a protein that is subsequently cleaved to product a protein of a modified TCR, a CAR and a dominant negative form of an inhibitor of the cell-mediated immune response of the immune cell. Preferably, the protein comprises an amino acid sequence selected from the group consisting of SEQ ID NOs:469-471.

As used herein, the term "chimeric antigen receptor" (CAR) refers to an artificial receptor that is engineered recombinantly to comprise at least an extracellular domain that binds specifically to an antigen or a target, a transmembrane domain and an intracellular T cell receptor-activating signaling domain. Engagement of the extracellular domain of the CAR with the target antigen on the surface of a target cell results in clustering of the CAR and delivers an activation stimulus to the CAR-containing cell. CARs redirect the specificity of immune effector cells and trigger proliferation, cytokine production, phagocytosis and/or production of molecules that can mediate cell death of the target antigen-expressing cell in a major histocompatibility (MHC)-independent manner.

A CAR can, for example, comprise an scFv or a peptide ligand fused to a TCR CD3 transmembrane region and endodomain. An scFv is a fusion protein of the variable regions of the heavy ($V_H$) and light ($V_L$) chains of immunoglobulins via a short linker peptide of approximately 10 to 25 amino acids (Huston J. S. et al. Proc Natl Acad Sci USA 1988; 85(16):5879-5883). The linker can be glycine-rich for flexibility, and serine or threonine rich for solubility. A linker peptide can connect the N-terminus of the $V_H$ to the C-terminus of the $V_L$, or vice versa. The peptide ligand can be any peptide that binds specifically to a receptor of interest. The scFv or peptide ligand can be preceded by a signal peptide to direct the protein to the endoplasmic reticulum, and subsequently the T cell surface. In the CAR, the scFv or peptide ligand can be fused to a TCR transmembrane and endodomain. A flexible spacer can be included between the scFv and the TCR transmembrane domain to allow for variable orientation and antigen binding. The endodomain is the functional signal-transmitting domain of the receptor. An endodomain of a CAR can comprise, for example, intracellular signaling domains from the CD3 ζ-chain, or from receptors such as CD28, 41BB, or ICOS. A CAR can comprise multiple signaling domains, for example, but not limited to, CD3z-CD28-41BB or CD3z-CD28-OX40.

The CAR can bind specifically to a tumor-specific antigen expressed by cancer cells. For example, the T cells can be modified to express a CAR that binds specifically to a tumor antigen that is expressed by the cancer cells in a specific cancer patient. Tumor antigens expressed by cancer cells in the cancer patient can identified using standard techniques. According to an embodiment of the invention, the CAR binds specifically to mesothelin. According to another embodiment of the invention, the CAR binds specifically to FSHR. According to yet another embodiment of the invention, the CAR binds specifically to mesothelin and FSHR.

In certain general aspects, the invention relates to an isolated polynucleotide comprising a nucleotide sequence encoding a chimeric antigen receptor (CAR). The CAR comprises:

(a) an extracellular domain comprising a first polypeptide that binds specifically to a follicle-stimulating hormone receptor (FSHR), and an antigen binding fragment that binds specifically to a tumor antigen;
(b) a transmembrane domain; and
(c) an intracellular domain, wherein the CAR optionally further comprises a signal peptide at its amino terminus and a hinge region connecting the extracellular domain and the transmembrane domain.

In certain embodiments, the first polypeptide that binds specifically to the FSHR comprises an amino acid sequence selected from the group consisting of SEQ ID NOs:319-331. In certain embodiments, the first polypeptide comprises the amino acid sequence of SEQ ID NO:319.

In certain embodiments, the first polypeptide is connected to the amino terminus or carboxy terminus of the antigen binding fragment via a linker. The linker can, for example, be selected from the group consisting of a $G_4S$ linker, a $(G_4S)_2$ linker, a $(G_4S)_3$ linker, a $(G_4S)_4$ linker, and a $(G_4S)_5$ linker.

In certain embodiments, the tumor antigen is selected from the group consisting of mesothelin, folate receptor α, mucin 16 (MUC16), prostate-specific membrane antigen (PSMA), human epidermal growth factor receptor 2 (HER2), epidermal growth factor receptor (EGFR), and vascular endothelial growth factor receptor (VEGFR). The tumor antigen can, for example, be mesothelin, preferably human mesothelin.

In certain embodiments, the antigen binding fragment is a Fab, a Fab', a F(ab')$_2$, an Fv, a single-chain variable fragment (scFv), a minibody, a diabody, a single-domain antibody (sdAb), a light chain variable domain ($V_L$), or a variable domain ($V_HH$) of a camelid antibody.

In other general aspects, the CAR comprises:
(a) an extracellular domain comprising an antigen binding fragment that binds specifically to mesothelin, preferably human mesothelin;
(b) a transmembrane domain; and
(c) an intracellular signaling domain, wherein the CAR optionally further comprises a signal peptide at the amino terminus and a hinge region connecting the extracellular domain and the transmembrane domain, and wherein the antigen binding fragment is (i) a single domain antibody (sdAb) or (ii) a single chain variable fragment (scFv). In certain embodiments, the CAR further comprises a polypeptide that binds specifically to a follicle-stimulating hormone receptor (FSHR). The polypeptide that binds specifically to FSHR can, for example, comprise an amino acid sequence selected from the group consisting of an amino acid sequence at least 90% identical to SEQ ID NOs:319-331, respectively. In certain embodiments, the polypeptide that binds specifically to FSHR can comprise the amino acid sequence of SEQ ID NO:319.

In certain embodiments, the extracellular domain of the CAR is preceded by a signal peptide at the amino-terminus. Any suitable signal peptide can be used in the invention. The signal peptide can, for example, be derived from a natural, synthetic, semi-synthetic, or recombinant source. According to one embodiment, the signal peptide is a human CD8α signal peptide, a human CD3δ signal peptide, a human CD3ζ signal peptide, a human GMCSFR signal peptide, a human 4-1BB signal peptide, or a derivative thereof. According to particular embodiments, the signal peptide is a human CD8α signal peptide. The human CD8α signal peptide comprises an amino acid sequence at least 90% identical to SEQ ID NO:340, preferably the amino acid sequence of SEQ ID NO:340. The signal peptide can be cleaved by a signal peptidase during or after completion of translocation of the CAR to generate a mature CAR free of the signal peptide.

In certain embodiments, the CAR can further comprise a hinge region connecting the extracellular domain and the transmembrane domain. The hinge region functions to move the extracellular domain away from the surface of the engineered immune cell to enable proper cell/cell contact, binding to the target or antigen and activation (Patel et al., Gene Therapy 6:412-9 (1999)). Any suitable hinge region can be used in a CAR of the invention. The hinge region can be derived from a natural, synthetic, semi-synthetic, or recombinant source. According to particular embodiments, the hinge region of the CAR is a hinge region from a CD8α peptide. In particular embodiments, the hinge region comprises an amino acid sequence at least 90% identical to SEQ ID NO:341, preferably the amino acid sequence of SEQ ID NO:341.

A CAR of the invention comprises a transmembrane domain. Any suitable transmembrane domain can be used in a CAR of the invention. The transmembrane domain can be derived from a natural, synthetic, semi-synthetic, or recombinant source. According to some embodiments, the transmembrane domain is a transmembrane domain from a peptide selected from the group consisting of a CD8α peptide, a CD28 peptide, a CD4 peptide, a CD3ζ peptide, a CD2 peptide, a 4-1BB peptide, an OX40 peptide, an ICOS peptide, a CTLA-4 peptide, a PD-1 peptide, a LAG-3 peptide, a 2B4 peptide, a BTLA peptide, a GMCSFR peptide, and the like. In particular embodiments, the transmembrane domain is a CD8α transmembrane domain. The CD8α transmembrane domain can comprise an amino acid sequence at least 90% identical to SEQ ID NO:342, preferably the amino acid sequence of SEQ ID NO:342.

A CAR of the invention comprises an intracellular signaling domain. Any suitable intracellular domain can be used in a CAR of the invention. In particular embodiments, the entire intracellular signaling domain is used. In other particular embodiments, a truncated portion of the signaling domain that transduces the effector or signal is used. According to embodiments of the invention, the intracellular signaling domain generates a signal that promotes an immune effector function of the CAR-containing cell, e.g., a CAR-T cell, including, but not limited to, proliferation, activation, and/or differentiation. In particular embodiments, the signal promotes, e.g., cytolytic activity, helper activity, and/or cytokine secretion of the CAR-T cell. According to some embodiments, the intracellular signaling domain of the CAR comprises a signaling domain of an Fcγ receptor (FcγR), an Fcε receptor (FcεR), an Fcα receptor (FcαR), neonatal Fc receptor (FcRn), CD3, CD3ζ, CD3 γ, CD3δ, CD3ε, CD4, CD5, CD8, CD21, CD22, CD28, CD32, CD40L (CD154), CD45, CD66δ, CD79α, CD79β, CD80, CD86, CD278 (also known as ICOS), CD247ζ, CD247η, DAP10, DAP12, FYN, LAT, Lck, MAPK, MHC complex, NFAT, NF-κB, PLC-γ, iC3b, C3dg, C3d, and Zap70. According to some embodiments, the intracellular signaling domain is selected from the group consisting of a signaling domain of CD3ζ, FcRγ, FcRβ, CD3γ, CD3δ, CD3ε, CD5, CD22, CD79α, CD79β, and CD66δ.

According to particular embodiments, the intracellular signaling domain further comprises one or more co-stimulatory signaling domains. The co-stimulatory domain can, for example, comprise a signaling domain of a peptide selected from: 2B4/CD244/SLAMF4, 4-1BB/TNFSF9/CD137, B7-1/CD80, B7-2/CD86, B7-H1/PD-L1, B7-H2, B7-H3, B7-H4, B7-H6, B7-H7, BAFF-R/TNFRSF13C, BAFF/BLyS/TNFSF13B, BLAME/SLAMF8, BTLA/CD272, CD100 (SEMA4D), CD103, CD11a, CD11b, CD11c, CD11d, CD150, CD160 (BY55), CD18, CD19, CD2, CD200, CD229/SLAMF3, CD27 Ligand/TNFSF7, CD27/TNFRSF7, CD28, CD29, CD2F-10/SLAMF9, CD30 Ligand/TNFSF8, CD30/TNFRSF8, CD300a/LMIR1, CD4, CD40 Ligand/TNFSF5, CD40/TNFRSF5, CD48/SLAMF2, CD49a, CD49D, CD49f, CD53, CD58/LFA-3, CD69, CD7, CD8a, CD813, CD82/Kai-1, CD84/SLAMF5, CD90/Thy1, CD96, CDS, CEACAM1, CRACC/SLAMF7, CRTAM, CTLA-4, DAP12, Dectin-1/CLEC7A, DNAM1 (CD226), DPPIV/CD26, DR3/TNFRSF25, EphB6, GADS, Gi24/VISTA/B7-H5, GITR Ligand/TNFSF18, GITR/TNFRSF18, HLA Class I, HLA-DR, HVEM/TNFRSF14, IA4, ICAM-1, ICOS/CD278, Ikaros, IL2R β, IL2R γ, IL7R α, Integrin α4/CD49d, Integrin α4β1, Integrin α4β7/LPAM-1, IPO-3, ITGA4, ITGA6, ITGAD, ITGAE, ITGAL, ITGAM, ITGAX, ITGB1, ITGB2, ITGB7, KIRDS2, LAG-3, LAT, LIGHT/TNFSF14, LTBR, Ly108, Ly9 (CD229), lymphocyte function associated antigen-1 (LFA-1), Lymphotoxin-α/TNF-β, NKG2C, NKG2D, NKp30, NKp44, NKp46, NKp80 (KLRF1), NTB-A/SLAMF6, OX40 Ligand/TNFSF4, OX40/TNFRSF4, PAG/Cbp, PD-1, PDCD6, PD-L2/B7-DC, PSGL1, RELT/TNFRSF19L, SELPLG (CD162), SLAM (SLAMF1), SLAM/CD150, SLAMF4 (CD244), SLAMF6 (NTB-A), SLAMF7, SLP-76, TACI/TNFRSF13B, TCL1A, TCL1B, TIM-1/KIM-1/HAVCR, TIM-4, TL1A/TNFSF15, TNF RII/TNFRSF1B, TNF-α, TRANCE/RANKL, TSLP, TSLP R, VLA1, and VLA-6. In certain embodiments, the costimulatory domain is selected from the group consisting of a costimulatory domain of one or more of CD28, 4-1BB (CD137), CD27, OX40, CD27, CD40, PD-1, ICOS, lymphocyte function-associated antigen-1 (LFA-1), CD2, CD7, LIGHT, NKG2C, B7-H3, TNFRSF9, TNFRSF4, TNFRSF8, CD40LG, ITGB2, KLRC2, TNFRSF18, TNFRSF14, HAVCR1, LGALS9, CD83, and a ligand that specifically binds with CD83.

In certain embodiments, the CAR is a tandem CAR that binds specifically to FSHR and mesothelin. Preferably, the CAR comprises an amino acid sequence selected from the group consisting of SEQ ID NOs:370-379 and SEQ ID NOs: 448-450.

In certain embodiments, the CAR binds specifically to mesothelin. Preferably, the CAR comprises an amino acid sequence selected from the group consisting of SEQ ID NOs:358-367 and SEQ ID NOs:445-447.

In certain embodiments, an isolated polynucleotide comprising a nucleotide sequence encoding a protein that is subsequently cleaved to produce a dual CAR containing a first CAR that binds specifically to FSHR and a second CAR that binds specifically to mesothelin. Preferably, the protein comprises an amino acid sequence selected from the group consisting of SEQ ID NOs:380-389 and SEQ ID NOs:451-453.

According to particular aspects, the isolated polynucleotide comprising the nucleotide sequence encoding a CAR further comprises a third nucleotide sequence. The third nucleotide sequence can, for example, encode a dominant negative form of an inhibitor of the cell-mediated immune response of the immune cell. The inhibitor of a cell-mediated immune response of the immune cell can, for example, be a transforming growth factor β (TGF-β) receptor (e.g., TGFβRII). In certain embodiments, the dominant negative form of the inhibitor comprises the amino acid sequence of SEQ ID NO:347.

The nucleotide sequence encoding the CAR can, for example, be connected to the third nucleotide sequence encoding the dominant negative form of the inhibitor of the cell-mediated immune response via a 2A peptide coding sequence.

In certain embodiments, an isolated polynucleotide comprising a nucleotide sequence encoding a protein that is subsequently cleaved to produce a protein that is subsequently cleaved to product one or more CARs and a dominant negative form of an inhibitor of the cell-mediated immune response of the immune cell. Preferably, the protein comprises an amino acid sequence selected from the group consisting of SEQ ID NOs:390-419 and SEQ ID NOs:460-468.

Immune Cells

According to particular aspects, the invention provides cells that are immune cells that comprise the isolated polynucleotides or vectors comprising the isolated polynucleotides comprising the nucleotide sequence encoding the CAR are provided herein. The immune cells comprising the isolated polynucleotides and/or vectors of the invention can be referred to as "engineered immune cells." Preferably, the engineered immune cells are derived from a human (are of human origin prior to being made recombinant).

The engineered immune cells can, for example, be cells of the lymphoid lineage. Non-limiting examples of cells of the lymphoid lineage can include T cells and Natural Killer (NK) cells. T cells express the T cell receptor (TCR), with most cells expressing α and β chains and a smaller population expressing γ and δ chains. T cells useful as engineered immune cells of the invention can be CD4$^+$ or CD8$^+$ and can include, but are not limited to, T helper cells (CD4$^+$), cytotoxic T cells (also referred to as cytotoxic T lymphocytes, CTL; CD8$^+$ cells), and memory T cells, including central memory T cells, stem-like memory T cells, and effector memory T cells, natural killer T cells, mucosal associated invariant T cells, and γδ T cells. Other exemplary immune cells include, but are not limited to, macrophages, antigen presenting cells (APCs), or any immune cell that expresses an inhibitor of a cell-mediated immune response, for example, an immune checkpoint inhibitor pathway receptor (e.g., PD-1). Precursor cells of immune cells that can be used according to the invention, include, hematopoietic stem and/or progenitor cells. Hematopoietic stem and/or progenitor cells can be derived from bone marrow, umbilical cord blood, adult peripheral blood after cytokine mobilization, and the like, by methods known in the art. The immune cells are engineered to recombinantly express the CARs of the invention.

Immune cells and precursor cells thereof can be isolated by methods known in the art, including commercially available methods (see, e.g., Rowland Jones et al., Lymphocytes: A Practical Approach, Oxford University Press, NY (1999)). Sources for immune cells or precursors thereof include, but are not limited to, peripheral blood, umbilical cord blood, bone marrow, or other sources of hematopoietic cells. Various techniques can be employed to separate the cells to isolated or enrich desired immune cells. For instance, negative selection methods can be used to remove cells that are not the desired immune cells. Additionally, positive selection methods can be used to isolated or enrich for the desired immune cells or precursors thereof, or a combination of positive and negative selection methods can be employed. If a particular type of cell is to be isolated, e.g., a particular T cell, various cell surface markers or combinations of markers (e.g., CD3, CD4, CD8, CD34) can be used to separate the cells.

The immune cells or precursor cells thereof can be autologous or non-autologous to the subject to which they are administered in the methods of treatment of the invention. Autologous cells are isolated from the subject to which the engineered immune cells recombinantly expressing the CAR are to be administered. Optionally, the cells can be obtained by leukapheresis, where leukocytes are selectively removed from withdrawn blood, made recombinant, and then retransfused into the donor. Alternatively, allogeneic cells from a non-autologous donor that is not the subject can be used. In the case of a non-autologous donor, the cells are typed and matched for human leukocyte antigen (HLA) to determine the appropriate level of compatibility. For both autologous and non-autologous cells, the cells can optionally be cryopreserved until ready for use.

Various methods for isolating immune cells that can be used for recombinant expression of the CARs of the invention have been described previously, and can be used, including, but not limited to, using peripheral donor lymphocytes (Sadelain et al., Nat. Rev. Cancer 3:35-45 (2003); Morgan et al., Science 314:126-9 (2006)), using lymphocyte cultures derived from tumor infiltrating lymphocytes (TILs) in tumor biopsies (Panelli et al., J. Immunol. 164:495-504 (2000); Panelli et al., J. Immunol. 164:4382-92 (2000)), and using selectively in vitro expanded antigen-specific peripheral blood leukocytes employing artificial antigen-presenting cells (AAPCs) or dendritic cells (Dupont et al., Cancer Res. 65:5417-427 (2005); Papanicolaou et al., Blood 102: 2498-505 (2003)). In the case of using stem cells, the cells can be isolated by methods well known in the art (see, e.g., Klug et al., Hematopoietic Stem Cell Protocols, Humana Press, N J (2002); Freshney et al., Culture of Human Stem Cells, John Wiley & Sons (2007)).

According to particular embodiments, the method of making the engineered immune cells comprises transfecting or transducing immune effector cells isolated from an individual such that the immune effector cells express one or more CAR(s) according to embodiments of the invention. Methods of preparing immune cells for immunotherapy are described, e.g., in WO2014/130635, WO2013/176916 and WO2013/176915, which are incorporated herein by reference. Individual steps that can be used for preparing engineered immune cells are disclosed, e.g., in WO2014/039523, WO2014/184741, WO2014/191128, WO2014/184744 and WO2014/184143, which are incorporated herein by reference.

In a particular embodiment, the immune effector cells, such as T cells, are genetically modified with CARs of the invention (e.g., transduced with a viral vector comprising a nucleic acid encoding a CAR) and then are activated and expanded in vitro. In various embodiments, T cells can be activated and expanded before or after genetic modification to express a CAR, using methods as described, for example, in U.S. Pat. Nos. 6,352,694, 6,534,055, 6,905,680, 6,692, 964, 5,858,358, 6,887,466, 6,905,681, 7,144,575, 7,067,318, 7,172,869, 7,232,566, 7,175,843, 5,883,223, 6,905,874, 6,797,514, 6,867,041, US2006/121005, which are incorporated herein by reference. T cells can be expanded in vitro or in vivo. Generally, the T cells of the invention can be expanded by contact with a surface having attached thereto an agent that stimulates a CD3/TCR complex-associated signal and a ligand that stimulates a co-stimulatory molecule on the surface of the T cells. As non-limiting examples, T cell populations can be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore, or by activation of the CAR itself. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. Conditions appropriate for T cell culture include, e.g., an appropriate media (e.g., Minimal Essential Media or RPMI Media 1640 or, X-vivo 5 (Lonza)) that can contain factors necessary for proliferation and viability, including serum (e.g., fetal bovine or human serum), cytokines, such as IL-2, IL-7, IL-15, and/or IL-21, insulin, IFN-g, GM-CSF, TGFβ and/or any other additives for the growth of cells known to the skilled artisan. In other embodiments, the T cells can be activated and stimulated to proliferate with feeder cells and appropriate antibodies and cytokines using methods such as those described in U.S. Pat. Nos. 6,040,177, 5,827,642, and WO2012129514, which are incorporated herein by reference.

Antigen-Binding Fragments
Antibodies

The invention generally relates to CAR constructs comprising an antigen binding fragment. The antigen binding fragment can, for example, be an antibody or antigen binding fragment thereof that specifically binds a tumor antigen. In certain aspects, the invention relates to an isolated antibody or antigen binding fragment that specifically binds a tumor antigen. The invention also generally relates to isolated anti-mesothelin antibodies, nucleic acids and expression vectors encoding the antibodies, recombinant cells containing the vectors, compositions comprising the antibodies, methods of making the antibodies, and methods of using the antibodies to treat diseases including cancer. The antibodies of the invention possess one or more desirable functional properties, including but not limited to high-affinity binding to a tumor antigen (e.g., mesothelin), high specificity to a tumor antigen (e.g., mesothelin), the ability to stimulate complement-dependent cytotoxicity (CDC), antibody-dependent phagocytosis (ADPC), and/or antibody-dependent cellular-mediated cytotoxicity (ADCC) against cells expressing a tumor antigen (e.g., mesothelin), and the ability to inhibit tumor growth in subjects in need thereof and in animal models when administered alone or in combination with other anti-cancer therapies.

The antigen binding fragment can, for example, be an antibody or antigen binding fragment thereof that specifically binds a tumor antigen. Any suitable tumor antigen for binding by an antibody or antigen binding fragment can be chosen based on the type of tumor and/or cancer exhibited by the subject to be treated. Suitable antigens include, but are not limited to, mesothelin (MSLN), prostate specific membrane antigen (PSMA), prostate stem cell antigen (PCSA), carbonic anhydrase IX (CAIX), carcinoembryonic antigen (CEA), CD5, CD7, CD10, CD19, CD20, CD22, CD30, CD33, CD34, CD38, CD41, CD44, CD49f, CD56, CD74, CD123, CD133, CD138, epithelial glycoprotein-2 (EGP 2), epithelial glycoprotein-40 (EGP-40), epithelial adhesion molecule (EpCAM), folate-binding protein (FBP), fetal acetylcholine receptor (AChR), folate receptor α and β (FRα and β), ganglioside G2 (GD2), ganglioside G3 (GD3), human epidermal growth factor receptor 2 (HER-2/ERB2), epidermal growth factor receptor (EGFR), epidermal growth factor receptor vIII (EGFRvIII), ERB3, ERB4, human telomerase reverse transcriptase (hTERT), interleukin-13 receptor subunit alpha-2 (IL-13Rα2), k-light chain, kinase insert domain receptor (KDR), Lewis A (CA19.9), Lewis Y (LeY), L1 cell adhesion molecule (LICAM), melanoma-associated antigen 1 (melanoma antigen family A1, MAGE-A1), Mucin-16 (Muc-16), Mucin 1 (Muc-1), NKG2D ligands, cancer-testis antigen NY-ESO-1, oncofetal antigen (h5T4), tumor-associated glycoprotein 72 (TAG-72), vascular endothelial growth factor receptor (VEGFR), vascular endothelial growth factor R2 (VEGF-R2), Wilms tumor protein (WT-1), type 1 tyrosine-protein kinase transmembrane receptor (ROR1), B7-H3 (CD276), B7-H6 (Nkp30), chondroitin sulfate proteoglycan-4 (CSPG4), DNAX accessory molecule (DNAM-1), ephrin type A receptor 2 (EpHA2), fibroblast associated protein (FAP), Gp100/HLA-A2, glypican 3 (GPC3), HA-1H, HERK-V, IL-11Rα, latent membrane protein (LMP1), neural cell-adhesion molecule (N-CAM/CD56), and trail receptor (TRAIL R). Suitable antigens are preferably selected from the group consisting of mesothelin, folate receptor α, mucin 16, prostate-specific membrane antigen (PSMA), human epidermal growth factor receptor 2 (HER2), epidermal growth factor receptor (EGFR), and vascular endothelial growth factor receptor (VEGFR).

In a general aspect, the invention relates to CAR constructs comprising antibodies or antigen binding fragments thereof that bind mesothelin and/or antibodies or antigen binding fragments thereof that bind mesothelin.

As used herein, the term "antibody" is used in a broad sense and includes immunoglobulin or antibody molecules including human, humanized, composite and chimeric antibodies and antibody fragments that are monoclonal or polyclonal. In general, antibodies are proteins or peptide chains that exhibit binding specificity to a specific antigen. Antibody structures are well known. Immunoglobulins can be assigned to five major classes (i.e., IgA, IgD, IgE, IgG and IgM), depending on the heavy chain constant domain amino acid sequence. IgA and IgG are further sub-classified as the isotypes IgA1, IgA2, IgG1, IgG2, IgG3 and IgG4. Accordingly, the antibodies of the invention can be of any of the five major classes or corresponding sub-classes. Preferably, the antibodies of the invention are IgG1, IgG2, IgG3 or IgG4. Antibody light chains of vertebrate species can be assigned to one of two clearly distinct types, namely kappa and lambda, based on the amino acid sequences of their constant domains. Accordingly, the antibodies of the invention can contain a kappa or lambda light chain constant domain. According to particular embodiments, the antibodies of the invention include heavy and/or light chain constant regions from rat or human antibodies. In addition to the heavy and light constant domains, antibodies contain an antigen-binding region that is made up of a light chain variable region and a heavy chain variable region, each of which contains three domains (i.e., complementarity determining regions 1-3; CDR1, CDR2, and CDR3). The light chain variable region domains are alternatively referred to as LCDR1, LCDR2, and LCDR3, and the heavy chain variable region domains are alternatively referred to as HCDR1, HCDR2, and HCDR3.

As used herein, the term an "isolated antibody" refers to an antibody which is substantially free of other antibodies having different antigenic specificities (e.g., an isolated antibody that specifically binds to mesothelin is substantially free of antibodies that do not bind to mesothelin). In addition, an isolated antibody is substantially free of other cellular material and/or chemicals.

As used herein, the term "monoclonal antibody" refers to an antibody obtained from a population of substantially homogeneous antibodies, i.e., the individual antibodies comprising the population are identical except for possible naturally occurring mutations that can be present in minor amounts. The monoclonal antibodies of the invention can be made by the hybridoma method, phage display technology, single lymphocyte gene cloning technology, or by recombinant DNA methods. For example, the monoclonal antibodies can be produced by a hybridoma which includes a B cell obtained from a transgenic nonhuman animal, such as a transgenic mouse or rat, having a genome comprising a human heavy chain transgene and a light chain transgene.

As used herein, the term "antigen-binding fragment" refers to an antibody fragment such as, for example, a diabody, a Fab, a Fab', a F(ab')2, an Fv fragment, a disulfide stabilized Fv fragment (dsFv), a (dsFv)$_2$, a bispecific dsFv (dsFv-dsFv'), a disulfide stabilized diabody (ds diabody), a single-chain antibody molecule (scFv), a single domain antibody (sdAb), a scFv dimer (bivalent diabody), a multi-specific antibody formed from a portion of an antibody comprising one or more CDRs, a camelized single domain antibody, a minibody, a nanobody, a domain antibody, a bivalent domain antibody, a light chain variable domain (VL), a variable domain (V$_H$H) of a camelid antibody, or any other antibody fragment that binds to an antigen but does not comprise a complete antibody structure. An antigen-binding fragment is capable of binding to the same antigen to which the parent antibody or a parent antibody fragment binds.

As used herein, the term "single-chain antibody" refers to a conventional single-chain antibody in the field, which comprises a heavy chain variable region and a light chain variable region connected by a short peptide of about 15 to about 20 amino acids (e.g., a linker peptide).

As used herein, the term "single domain antibody" refers to a conventional single domain antibody in the field, which comprises a heavy chain variable region and a heavy chain constant region or which comprises only a heavy chain variable region.

As used herein, the term "human antibody" refers to an antibody produced by a human or an antibody having an amino acid sequence corresponding to an antibody produced by a human made using any technique known in the art. This definition of a human antibody includes intact or full-length antibodies, fragments thereof, and/or antibodies comprising at least one human heavy and/or light chain polypeptide.

As used herein, the term "humanized antibody" refers to a non-human antibody that is modified to increase the sequence homology to that of a human antibody, such that the antigen-binding properties of the antibody are retained, but its antigenicity in the human body is reduced.

As used herein, the term "chimeric antibody" refers to an antibody wherein the amino acid sequence of the immunoglobulin molecule is derived from two or more species. The variable region of both the light and heavy chains often corresponds to the variable region of an antibody derived from one species of mammal (e.g., mouse, rat, rabbit, etc.) having the desired specificity, affinity, and capability, while the constant regions correspond to the sequences of an antibody derived from another species of mammal (e.g., human) to avoid eliciting an immune response in that species.

As used herein, the term "multispecific antibody" refers to an antibody that comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, the first and second epitopes are on the same antigen, e.g., the same protein (or subunit of a multimeric protein). In an embodiment, the first and second epitopes overlap or substantially overlap. In an embodiment, the first and second epitopes do not overlap or do not substantially overlap. In an embodiment, the first and second epitopes are on different antigens, e.g., the different proteins (or different subunits of a multimeric protein). In an embodiment, a multispecific antibody comprises a third, fourth, or fifth immunoglobulin variable domain. In an embodiment, a multispecific antibody is a bispecific antibody molecule, a trispecific antibody molecule, or a tetraspecific antibody molecule.

As used herein, the term "bispecific antibody" refers to a multispecific antibody that binds no more than two epitopes or two antigens. A bispecific antibody is characterized by a first immunoglobulin variable domain sequence which has binding specificity for a first epitope and a second immunoglobulin variable domain sequence that has binding specificity for a second epitope. In an embodiment, the first and second epitopes are on the same antigen, e.g., the same protein (or subunit of a multimeric protein). In an embodiment, the first and second epitopes overlap or substantially overlap. In an embodiment, the first and second epitopes are on different antigens, e.g., the different proteins (or different subunits of a multimeric protein). In an embodiment, a bispecific antibody comprises a heavy chain variable domain sequence and a light chain variable domain sequence which have binding specificity for a first epitope and a heavy chain variable domain sequence and a light chain variable domain sequence which have binding specificity for a second epitope. In an embodiment, a bispecific antibody comprises a half antibody, or fragment thereof, having binding specificity for a first epitope and a half antibody, or fragment thereof, having binding specificity for a second epitope. In an embodiment, a bispecific antibody comprises a scFv, or fragment thereof, having binding specificity for a first epitope, and a scFv, or fragment thereof, having binding specificity for a second epitope. In an embodiment, the first epitope is located on mesothelin and the second epitope is located on PD-1, PD-L1, CTLA-4, EGFR, HER-2, CD19, CD20, CD33, CD3, and/or other tumor associated immune suppressors or surface antigens.

As used herein, the term "mesothelin" refers to a 71-kD precursor protein, which is the cleaved by the endoprotease furin to release the secreted N-terminal region, called megakaryocyte potentiating factor (MPF). The 41-kD mature mesothelin (i.e., MPF) remains attached to the membrane (Yamaguchi N, et at., *Biol Chem.* 1994; 269: 805-808). The remaining GPI-linked mature mesothelin can also be shed from the cell through the action of the tumor necrosis factor α-converting enzyme protease (Zhang Y, et al., *Cancer Res.* 2011; 71: 5915-5922). The correlation of serum level of shed mesothelin with disease suggested a potential role for the mesothelin protein in cancer progression. While the biological function of mesothelin is not well understood. Mesothelin is known to bind to the ovarian cancer antigen MUC16 (cancer antigen 125) that has been shown to induce cell-to-cell adhesion and possibly contribute to peritoneal seeding and metastatic spread (Gubbels J A, et al., *Mol Cancer.* 2006; 5: 50). Furthermore, mesothelin knockout mice grow and reproduce normally and have no detectable phenotype. Bera T K, et al., *Mol Cell Biol.* 2000; 20: 2902-2906. The full length sequence of human mesothelin is provided by SEQ ID NO:315, and the sequence of the human 41-kD mature mesothelin is provided by SEQ ID NO:318.

As used herein, an antibody that "specifically binds to mesothelin" refers to an antibody that binds to a mesothelin, preferably a human mesothelin, with a KD of $1 \times 10^{-7}$ M or less, preferably $1 \times 10^{-8}$ M or less, more preferably $5 \times 10^{-9}$ M or less, $1 \times 10^{-9}$ M or less, $5 \times 10^{-10}$ M or less, or $1 \times 10^{-10}$ M or less. The term "KD" refers to the dissociation constant, which is obtained from the ratio of Kd to Ka (i.e., Kd/Ka) and is expressed as a molar concentration (M). KD values for antibodies can be determined using methods in the art in view of the present disclosure. For example, the KD of an antibody can be determined by using surface plasmon resonance, such as by using a biosensor system, e.g., a Biacore® system, or by using bio-layer interferometry technology, such as an Octet RED96 system.

The smaller the value of the KD of an antibody, the higher affinity that the antibody binds to a target antigen.

According to particular aspects, the invention relates to a CAR construct comprising an antigen binding fragment, wherein the antigen binding fragment is an antibody or antigen binding fragment that specifically binds a tumor antigen and/or an isolated antibody or antigen binding fragment that specifically binds a tumor antigen. The antibody or antigen binding fragment can, for example, be a Fab, a Fab', a F(ab')$_2$, an Fv, a single-chain variable fragment (scFv), a minibody, a diabody, a single-domain antibody (sdAb), a light chain variable domain (VL), or a variable domain (V$_H$H) of a camelid antibody.

In certain embodiments, the antibody or antigen binding fragment is a single domain antibody (sdAb) comprising a complementarity determining region 1 (CDR1), CDR2, and CDR3 having the polypeptide sequences of:
  a. SEQ ID NOs:34, 102, and 170, respectively;
  b. SEQ ID NOs:54, 122, and 190, respectively;
  c. SEQ ID NOs:55, 123, and 191, respectively;
  d. SEQ ID NOs:61, 129, and 197, respectively;
  e. SEQ ID NOs:31, 99, and 167, respectively;

f. SEQ ID NOs:32, 100, and 168, respectively;
g. SEQ ID NOs:33, 101, and 169, respectively;
h. SEQ ID NOs:35, 103, and 171, respectively;
i. SEQ ID NOs:36, 104, and 172, respectively;
j. SEQ ID NOs:37, 105, and 173, respectively;
k. SEQ ID NOs:38, 106, and 174, respectively;
l. SEQ ID NOs:39, 107, and 175, respectively;
m. SEQ ID NOs:40, 108, and 176, respectively;
n. SEQ ID NOs:41, 109, and 177, respectively;
o. SEQ ID NOs:42, 110, and 178, respectively;
p. SEQ ID NOs:43, 111, and 179, respectively;
q. SEQ ID NOs:44, 112, and 180, respectively;
r. SEQ ID NOs:45, 113, and 181, respectively;
s. SEQ ID NOs:46, 114, and 182, respectively;
t. SEQ ID NOs:47, 115, and 183, respectively;
u. SEQ ID NOs:48, 116, and 184, respectively;
v. SEQ ID NOs:49, 117, and 185, respectively;
w. SEQ ID NOs:50, 118, and 186, respectively;
x. SEQ ID NOs:51, 119, and 187, respectively;
y. SEQ ID NOs:52, 120, and 188, respectively;
z. SEQ ID NOs:53, 121, and 189, respectively;
aa. SEQ ID NOs:56, 124, and 192, respectively;
bb. SEQ ID NOs:57, 125, and 193, respectively;
cc. SEQ ID NOs:58, 126, and 194, respectively;
dd. SEQ ID NOs:59, 127, and 195, respectively;
ee. SEQ ID NOs:60, 128, and 196, respectively;
ff. SEQ ID NOs:62, 130, and 198, respectively;
gg. SEQ ID NOs:63, 131, and 199, respectively;
hh. SEQ ID NOs:64, 132, and 200, respectively;
ii. SEQ ID NOs:65, 133, and 201, respectively;
jj. SEQ ID NOs:66, 134, and 202, respectively;
kk. SEQ ID NOs:67, 135, and 203, respectively;
ll. SEQ ID NOs:68, 136, and 204, respectively; or
a variant thereof comprising up to about 3 (such as about any of 1, 2, or 3) amino acid substitutions in the CDR regions; wherein the single domain antibody binds specifically to mesothelin, preferably human mesothelin. In certain embodiments the single domain antibody comprises an amino acid sequence at least 85%, preferably 90%, more preferably 95% or more, such as 95%, 96%, 97%, 98%, or 99% identical to an amino acid sequence selected from the group consisting of SEQ ID NOs:221-258 and SEQ ID NOs:420-428. In certain embodiments, the single domain antibody comprises an amino acid sequence selected from the group consisting of SEQ ID NOs:221-258 and SEQ ID NOs:420-428, or a variant thereof. Preferably, the variant comprises one, two, three or more amino acid substitutions, deletions and/or insertions.

In one embodiment, the invention relates to a CAR construct comprising a single domain antibody or an isolated single domain antibody comprising a CDR1, CDR2, and CDR3, having the polypeptide sequences of SEQ ID NOs: 31, 99, and 167, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:221. Preferably, the CAR construct comprising the sdAb or the isolated sdAb comprises the polypeptide sequence of SEQ ID NO:221.

In one embodiment, the invention relates to a CAR construct comprising a single domain antibody or an isolated single domain antibody comprising a CDR1, CDR2, and CDR3, having the polypeptide sequences of SEQ ID NOs: 32, 100, and 168, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:222. Preferably, the CAR construct comprising the sdAb or the isolated sdAb comprises the polypeptide sequence of SEQ ID NO:222.

In one embodiment, the invention relates to a CAR construct comprising a single domain antibody or an isolated single domain antibody comprising a CDR1, CDR2, and CDR3, having the polypeptide sequences of SEQ ID NOs: 33, 101, and 169, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:223. Preferably, the CAR construct comprising the sdAb or the isolated sdAb comprises the polypeptide sequence of SEQ ID NO:223.

In one embodiment, the invention relates to a CAR construct comprising a single domain antibody or an isolated single domain antibody comprising a CDR1, CDR2, and CDR3, having the polypeptide sequences of SEQ ID NOs: 34, 102, and 170, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:224, 420, 421 or 422. Preferably, the CAR construct comprising the sdAb or the isolated sdAb comprises the polypeptide sequence of SEQ ID NO:224, 420, 421 or 422.

In one embodiment, the invention relates to a CAR construct comprising a single domain antibody or an isolated single domain antibody comprising a CDR1, CDR2, and CDR3, having the polypeptide sequences of SEQ ID NOs: 35, 103, and 171, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:225. Preferably, the CAR construct comprising the sdAb or the isolated sdAb comprises the polypeptide sequence of SEQ ID NO:225.

In one embodiment, the invention relates to a CAR construct comprising a single domain antibody or an isolated single domain antibody comprising a CDR1, CDR2, and CDR3, having the polypeptide sequences of SEQ ID NOs: 36, 104, and 172, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:226. Preferably, the CAR construct comprising the sdAb or the isolated sdAb comprises the polypeptide sequence of SEQ ID NO:226.

In one embodiment, the invention relates to a CAR construct comprising a single domain antibody or an isolated single domain antibody comprising a CDR1, CDR2, and CDR3, having the polypeptide sequences of SEQ ID NOs: 37, 105, and 173, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:227. Preferably, the CAR construct comprising the sdAb or the isolated sdAb comprises the polypeptide sequence of SEQ ID NO:227.

In one embodiment, the invention relates to a CAR construct comprising a single domain antibody or an isolated single domain antibody comprising a CDR1, CDR2, and CDR3, having the polypeptide sequences of SEQ ID NOs: 38, 106, and 174, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:228. Preferably, the CAR construct comprising the sdAb or the isolated sdAb comprises the polypeptide sequence of SEQ ID NO:228.

In one embodiment, the invention relates to a CAR construct comprising a single domain antibody or an isolated single domain antibody comprising a CDR1, CDR2, and CDR3, having the polypeptide sequences of SEQ ID NOs: 39, 107, and 175, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:229. Preferably, the CAR construct comprising the sdAb or the isolated sdAb comprises the polypeptide sequence of SEQ ID NO:229.

In one embodiment, the invention relates to a CAR construct comprising a single domain antibody or an isolated single domain antibody comprising a CDR1, CDR2, and CDR3, having the polypeptide sequences of SEQ ID NOs: 40, 108, and 176, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:230. Preferably, the CAR construct comprising the sdAb or the isolated sdAb comprises the polypeptide sequence of SEQ ID NO:230.

In one embodiment, the invention relates to a CAR construct comprising a single domain antibody or an isolated single domain antibody comprising a CDR1, CDR2, and CDR3, having the polypeptide sequences of SEQ ID NOs: 41, 109, and 177, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:231. Preferably, the CAR construct comprising the sdAb or the isolated sdAb comprises the polypeptide sequence of SEQ ID NO:231.

In one embodiment, the invention relates to a CAR construct comprising a single domain antibody or an isolated single domain antibody comprising a CDR1, CDR2, and CDR3, having the polypeptide sequences of SEQ ID NOs: 42, 110, and 178, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:232. Preferably, the CAR construct comprising the sdAb or the isolated sdAb comprises the polypeptide sequence of SEQ ID NO:232.

In one embodiment, the invention relates to a CAR construct comprising a single domain antibody or an isolated single domain antibody comprising a CDR1, CDR2, and CDR3, having the polypeptide sequences of SEQ ID NOs: 43, 111, and 179, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:233. Preferably, the CAR construct comprising the sdAb or the isolated sdAb comprises the polypeptide sequence of SEQ ID NO:233.

In one embodiment, the invention relates to a CAR construct comprising a single domain antibody or an isolated single domain antibody comprising a CDR1, CDR2, and CDR3, having the polypeptide sequences of SEQ ID NOs: 44, 112, and 180, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:234. Preferably, the CAR construct comprising the sdAb or the isolated sdAb comprises the polypeptide sequence of SEQ ID NO:234.

In one embodiment, the invention relates to a CAR construct comprising a single domain antibody or an isolated single domain antibody comprising a CDR1, CDR2, and CDR3, having the polypeptide sequences of SEQ ID NOs: 45, 113, and 181, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:235. Preferably, the CAR construct comprising the sdAb or the isolated sdAb comprises the polypeptide sequence of SEQ ID NO:235.

In one embodiment, the invention relates to a CAR construct comprising a single domain antibody or an isolated single domain antibody comprising a CDR1, CDR2, and CDR3, having the polypeptide sequences of SEQ ID NOs: 46, 114, and 182, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:236. Preferably, the CAR construct comprising the sdAb or the isolated sdAb comprises the polypeptide sequence of SEQ ID NO:236.

In one embodiment, the invention relates to a CAR construct comprising a single domain antibody or an isolated single domain antibody comprising a CDR1, CDR2, and CDR3, having the polypeptide sequences of SEQ ID NOs: 47, 115, and 183, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:237. Preferably, the CAR construct comprising the sdAb or the isolated sdAb comprises the polypeptide sequence of SEQ ID NO:237.

In one embodiment, the invention relates to a CAR construct comprising a single domain antibody or an isolated single domain antibody comprising a CDR1, CDR2, and CDR3, having the polypeptide sequences of SEQ ID NOs: 48, 116, and 184, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:238. Preferably, the CAR construct comprising the sdAb or the isolated sdAb comprises the polypeptide sequence of SEQ ID NO:238.

In one embodiment, the invention relates to a CAR construct comprising a single domain antibody or an isolated single domain antibody comprising a CDR1, CDR2, and CDR3, having the polypeptide sequences of SEQ ID NOs: 49, 117, and 185, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:239. Preferably, the CAR construct comprising the sdAb or the isolated sdAb comprises the polypeptide sequence of SEQ ID NO:239.

In one embodiment, the invention relates to a CAR construct comprising a single domain antibody or an isolated single domain antibody comprising a CDR1, CDR2, and CDR3, having the polypeptide sequences of SEQ ID NOs: 50, 118, and 186, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:240. Preferably, the CAR construct comprising the sdAb or the isolated sdAb comprises the polypeptide sequence of SEQ ID NO:240.

In one embodiment, the invention relates to a CAR construct comprising a single domain antibody or an isolated single domain antibody comprising a CDR1, CDR2, and CDR3, having the polypeptide sequences of SEQ ID NOs: 51, 119, and 187, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:241. Preferably, the CAR construct comprising the sdAb or the isolated sdAb comprises the polypeptide sequence of SEQ ID NO:241.

In one embodiment, the invention relates to a CAR construct comprising a single domain antibody or an isolated single domain antibody comprising a CDR1, CDR2, and CDR3, having the polypeptide sequences of SEQ ID NOs: 52, 120, and 188, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:242. Preferably, the CAR construct comprising the sdAb or the isolated sdAb comprises the polypeptide sequence of SEQ ID NO:242.

In one embodiment, the invention relates to a CAR construct comprising a single domain antibody or an isolated single domain antibody comprising a CDR1, CDR2, and CDR3, having the polypeptide sequences of SEQ ID NOs: 53, 121, and 189, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:243. Preferably, the CAR construct comprising the sdAb or the isolated sdAb comprises the polypeptide sequence of SEQ ID NO:243.

In one embodiment, the invention relates to a CAR construct comprising a single domain antibody or an isolated single domain antibody comprising a CDR1, CDR2, and CDR3, having the polypeptide sequences of SEQ ID NOs: 54, 122, and 190, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:244. Preferably, the CAR construct comprising the sdAb or the isolated sdAb comprises the polypeptide sequence of SEQ ID NO:244.

In one embodiment, the invention relates to a CAR construct comprising a single domain antibody or an isolated single domain antibody comprising a CDR1, CDR2, and CDR3, having the polypeptide sequences of SEQ ID NOs: 55, 123, and 191, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:245. Preferably, the CAR construct comprising the sdAb or the isolated sdAb comprises the polypeptide sequence of SEQ ID NO:245.

In one embodiment, the invention relates to a CAR construct comprising a single domain antibody or an isolated single domain antibody comprising a CDR1, CDR2, and CDR3, having the polypeptide sequences of SEQ ID NOs: 56, 124, and 192, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:246. Preferably, the CAR construct comprising the sdAb or the isolated sdAb comprises the polypeptide sequence of SEQ ID NO:246.

In one embodiment, the invention relates to a CAR construct comprising a single domain antibody or an isolated single domain antibody comprising a CDR1, CDR2, and CDR3, having the polypeptide sequences of SEQ ID NOs: 57, 125, and 193, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:247. Preferably, the CAR construct comprising the sdAb or the isolated sdAb comprises the polypeptide sequence of SEQ ID NO:247.

In one embodiment, the invention relates to a CAR construct comprising a single domain antibody or an isolated single domain antibody comprising a CDR1, CDR2, and CDR3, having the polypeptide sequences of SEQ ID NOs: 58, 126, and 194, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:248. Preferably, the CAR construct comprising the sdAb or the isolated sdAb comprises the polypeptide sequence of SEQ ID NO:248.

In one embodiment, the invention relates to a CAR construct comprising a single domain antibody or an isolated single domain antibody comprising a CDR1, CDR2, and CDR3, having the polypeptide sequences of SEQ ID NOs: 59, 127, and 195, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:249. Preferably, the CAR construct comprising the sdAb or the isolated sdAb comprises the polypeptide sequence of SEQ ID NO:249.

In one embodiment, the invention relates to a CAR construct comprising a single domain antibody or an isolated single domain antibody comprising a CDR1, CDR2, and CDR3, having the polypeptide sequences of SEQ ID NOs:

60, 128, and 196, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:250. Preferably, the CAR construct comprising the sdAb or the isolated sdAb comprises the polypeptide sequence of SEQ ID NO:250.

In one embodiment, the invention relates to a CAR construct comprising a single domain antibody or an isolated single domain antibody comprising a CDR1, CDR2, and CDR3, having the polypeptide sequences of SEQ ID NOs: 61, 129, and 197, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:251. Preferably, the CAR construct comprising the sdAb or the isolated sdAb comprises the polypeptide sequence of SEQ ID NO:251.

In one embodiment, the invention relates to a CAR construct comprising a single domain antibody or an isolated single domain antibody comprising a CDR1, CDR2, and CDR3, having the polypeptide sequences of SEQ ID NOs: 62, 130, and 198, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:252. Preferably, the CAR construct comprising the sdAb or the isolated sdAb comprises the polypeptide sequence of SEQ ID NO:252.

In one embodiment, the invention relates to a CAR construct comprising a single domain antibody or an isolated single domain antibody comprising a CDR1, CDR2, and CDR3, having the polypeptide sequences of SEQ ID NOs: 63, 131, and 199, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:253. Preferably, the CAR construct comprising the sdAb or the isolated sdAb comprises the polypeptide sequence of SEQ ID NO:253.

In one embodiment, the invention relates to a CAR construct comprising a single domain antibody or an isolated single domain antibody comprising a CDR1, CDR2, and CDR3, having the polypeptide sequences of SEQ ID NOs: 64, 132, and 200, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:254. Preferably, the CAR construct comprising the sdAb or the isolated sdAb comprises the polypeptide sequence of SEQ ID NO:254.

In one embodiment, the invention relates to a CAR construct comprising a single domain antibody or an isolated single domain antibody comprising a CDR1, CDR2, and CDR3, having the polypeptide sequences of SEQ ID NOs: 65, 133, and 201, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:255. Preferably, the CAR construct comprising the sdAb or the isolated sdAb comprises the polypeptide sequence of SEQ ID NO:255.

In one embodiment, the invention relates to a CAR construct comprising a single domain antibody or an isolated single domain antibody comprising a CDR1, CDR2, and CDR3, having the polypeptide sequences of SEQ ID NOs: 66, 134, and 202, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:256, 426, 427 or 428. Preferably, the CAR construct comprising the sdAb or the isolated sdAb comprises the polypeptide sequence of SEQ ID NO:256, 426, 427 or 428.

In one embodiment, the invention relates to a CAR construct comprising a single domain antibody or an isolated single domain antibody comprising a CDR1, CDR2, and CDR3, having the polypeptide sequences of SEQ ID NOs: 67, 135, and 203, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:257, 423, 424 or 425. Preferably, the CAR construct comprising the sdAb or the isolated sdAb comprises the polypeptide sequence of SEQ ID NO:257, 423, 424 or 425.

In one embodiment, the invention relates to a CAR construct comprising a single domain antibody or an isolated single domain antibody comprising a CDR1, CDR2, and CDR3, having the polypeptide sequences of SEQ ID NOs: 68, 136, and 204, respectively. In another embodiment, the CAR construct comprising the single domain antibody (sdAb) or the isolated sdAb comprises a polypeptide sequence at least 85%, preferably 90%, more preferably 95% or more, such as 95%, 96%, 97%, 98%, or 99% identical to SEQ ID NO:258. Preferably, the CAR construct comprising the sdAb or the isolated sdAb comprises the polypeptide sequence of SEQ ID NO:258.

In certain embodiments, the antibody or antigen binding fragment thereof is a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
  a. SEQ ID NOs:1, 69, 137, 2, 70, and 138, respectively;
  b. SEQ ID NOs:19, 87, 155, 20, 88, and 156, respectively;
  c. SEQ ID NOs:23, 91, 159, 24, 92, and 160, respectively;
  d. SEQ ID NOs:25, 93, 161, 26, 94, and 162, respectively;
  e. SEQ ID NOs:27, 95, 163, 28, 96, and 164, respectively;
  f. SEQ ID NOs:29, 97, 165, 30, 98, and 166, respectively;
  g. SEQ ID NOs:3, 71, 139, 4, 72, and 140, respectively;
  h. SEQ ID NOs:5, 73, 141, 6, 74, and 142, respectively;
  i. SEQ ID NOs:7, 75, 143, 8, 76, and 144, respectively;
  j. SEQ ID NOs:9, 77, 145, 10, 78, and 146, respectively;
  k. SEQ ID NOs:11, 79, 147, 12, 80, and 148, respectively;
  l. SEQ ID NOs:13, 81, 149, 14, 82, and 150, respectively;
  m. SEQ ID NOs:15, 83, 151, 16, 84, and 152, respectively;
  n. SEQ ID NOs:17, 85, 153, 18, 86, and 154, respectively;
  o. SEQ ID NOs:21, 89, 157, 22, 90, and 158, respectively; or
a variant thereof comprising up to about 3 (such as about any of 1, 2, or 3) amino acid substitutions in the CDR regions; wherein the scFv binds specifically to mesothelin, preferably human mesothelin. In certain embodiments, the scFv comprises an amino acid sequence at least 85%, preferably 90%, more preferably 95% or more, such as 95%, 96%, 97%, 98%, or 99% identical to an amino acid sequence selected from the group consisting of SEQ ID NOs:205-220.

In certain embodiments, the antibody or antigen binding fragment thereof is a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
  a. SEQ ID NOs:1, 69, 137, 2, 70, and 138, respectively;
  b. SEQ ID NOs:19, 87, 155, 20, 88, and 156, respectively;
  c. SEQ ID NOs:23, 91, 159, 24, 92, and 160, respectively;
  d. SEQ ID NOs:25, 93, 161, 26, 94, and 162, respectively;
  e. SEQ ID NOs:27, 95, 163, 28, 96, and 164, respectively;
  f. SEQ ID NOs:29, 97, 165, 30, 98, and 166, respectively;
  g. SEQ ID NOs:3, 71, 139, 4, 72, and 140, respectively;
  h. SEQ ID NOs:5, 73, 141, 6, 74, and 142, respectively;
  i. SEQ ID NOs:7, 75, 143, 8, 76, and 144, respectively;
  j. SEQ ID NOs:9, 77, 145, 10, 78, and 146, respectively;
  k. SEQ ID NOs:11, 79, 147, 12, 80, and 148, respectively;
  l. SEQ ID NOs:13, 81, 149, 14, 82, and 150, respectively;
  m. SEQ ID NOs:15, 83, 151, 16, 84, and 152, respectively;
  n. SEQ ID NOs:17, 85, 153, 18, 86, and 154, respectively; or
  o. SEQ ID NOs:21, 89, 157, 22, 90, and 158, respectively, or
a variant thereof comprising up to about 3 (such as about any of 1, 2, or 3) amino acid substitutions in the CDR regions, wherein the scFv binds specifically to mesothelin, preferably human mesothelin. In certain embodiments, the scFv comprises an amino acid sequence at least 85%, preferably 90%, more preferably 95% or more, such as 95%, 96%, 97%, 98%, or 99% identical to an amino acid sequence selected from the group consisting of SEQ ID NOs:205-220. In certain embodiments, the single domain antibody comprises an amino acid sequence selected from the group consisting of SEQ ID NOs: 205-220, or a variant thereof. Preferably, the variant comprises one, two, three or more amino acid substitutions, deletions and/or insertions.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:1, 69, 137, 2, 70, and 138, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:205 or 206. Preferably, the CAR construct comprising the scFv and/or the isolated scFv comprises a polypeptide sequence of SEQ ID NO:205 or 206.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:3, 71, 139, 4, 72, and 140, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:207. Preferably, the CAR construct comprising the scFv and/or the isolated scFv comprises a polypeptide sequence of SEQ ID NO:207.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:5, 73, 141, 6, 74, and 142, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:208. Preferably, the CAR construct comprising the scFv and/or the isolated scFv comprises a polypeptide sequence of SEQ ID NO:208.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:7, 75, 143, 8, 76, and 144, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:209. Preferably, the CAR construct comprising the scFv and/or the isolated scFv comprises a polypeptide sequence of SEQ ID NO:209.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:9, 77, 145, 10, 78, and 146, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:210. Preferably, the CAR construct comprising the scFv and/or the isolated scFv comprises a polypeptide sequence of SEQ ID NO:210.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:11, 79, 147, 12, 80, and 148, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:211. Preferably, the CAR construct comprising the scFv and/or the isolated scFv comprises a polypeptide sequence of SEQ ID NO:211.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:13, 81, 149, 14, 82, and 150, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:212. Preferably, the CAR construct comprising the scFv and/or the isolated scFv comprises a polypeptide sequence of SEQ ID NO:212.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:15, 83, 151, 16, 84, and 152, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:213. Preferably, the CAR construct comprising the scFv and/or the isolated scFv comprises a polypeptide sequence of SEQ ID NO:213.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:17, 85, 153, 18, 86, and 154, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:214. Preferably, the CAR construct comprising the scFv and/or the isolated scFv comprises a polypeptide sequence of SEQ ID NO:214.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:19, 87, 155, 20, 88, and 156, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:215. Preferably, the CAR construct comprising the scFv and/or the isolated scFv comprises a polypeptide sequence of SEQ ID NO:215.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:21, 89, 157, 22, 90, and 158, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:216. Preferably, the CAR construct comprising the scFv and/or the isolated scFv comprises a polypeptide sequence of SEQ ID NO:216.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:23, 91, 159, 24, 92, and 160, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:217. Preferably, the CAR construct comprising the scFv and/or the isolated scFv comprises a polypeptide sequence of SEQ ID NO:217.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:25, 93, 161, 26, 94, and 162, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:218. Preferably, the CAR construct comprising the scFv and/or the isolated scFv comprises a polypeptide sequence of SEQ ID NO:218.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:27, 95, 163, 28, 96, and 164, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:219. Preferably, the CAR construct comprising the scFv and/or the isolated scFv comprises a polypeptide sequence of SEQ ID NO:219.

In one embodiment, the invention relates to a CAR construct comprising a single chain variable fragment (scFv) or an isolated scFv, comprising HCDR1, HCDR2, HCDR3, LCDR1, LCDR2, and LCDR3, having the polypeptide sequences of SEQ ID NOs:29, 97, 165, 30, 98, and 166, respectively. In another embodiment, the CAR construct comprising the scFv and/or the isolated scFv comprises a polypeptide sequence at least 85%, preferably 90%, more preferably 95% or more, such as 95%, 96%, 97%, 98%, or 99% identical to SEQ ID NO:220. Preferably, the CAR construct comprising the scFv and/or the isolated scFv comprises a polypeptide sequence of SEQ ID NO:220.

In another general aspect, the invention relates to a method of producing a modified TCR complex, a CAR construct or an antibody or antigen-binding fragment thereof of the invention, comprising culturing a cell comprising a nucleic acid encoding a protein of the modified TCR complex, the CAR construct or the antibody or antigen-binding fragment thereof under conditions to produce the modified TCR complex, the CAR construct or the antibody or antigen-binding fragment thereof of the invention. Optionally, the method further comprises recovering modified TCR complex, the CAR construct or the antibody or antigen-binding fragment thereof from the cell or cell culture (e.g., from the supernatant). Expressed antibodies or antigen-binding fragments thereof can be harvested from the cells and purified according to conventional techniques known in the art and as described herein.

Follicle Stimulating Hormone Receptor (FSHR) Binding Peptides

As used herein, the term "FSHR binding domain" or "FSHR binding peptide" refers to a peptide domain or polypeptide that specifically binds to a follicle stimulating hormone receptor (FSHR). In certain embodiments, the FSHR binding domain can comprise a follicle-stimulating hormone (FSH) or fragment thereof, a FSHR antagonist or fragment thereof, an antigen binding fragment that binds specifically to FSHR, and/or an anti-FSHR agonist or fragment thereof.

As used herein, the term "FSHR antagonist" refers to a molecule or fragment thereof that has affinity for a FSHR. The FSHR antagonist has affinity to the active site of FSHR, a similar or the same binding site as FSH. FSHR antagonist binding affinity to the FSHR can be reversible or irreversible.

In certain aspects, provided herein are CARs, wherein the CAR comprises an extracellular domain comprising a first polypeptide that binds specifically to a follicle-stimulating hormone receptor (FSHR). The first polypeptide can, for example, be a FSHR binding peptide. The FSHR binding peptide can, for example, be a FSH or fragment thereof, a FSHR antagonist or fragment thereof, an anti-FSHR antibody or fragment thereof, or an anti-FSHR agonist or fragment thereof.

In certain embodiments, the FSHR binding peptide can comprise an amino acid sequence derived from a FSH molecule. The FSHR binding peptide includes fragments, peptides, or polypeptide sequences derived from a FSH molecule. In one embodiment, the FSHR binding peptide comprises a FSHβ 33-53 peptide. In another embodiment, the FSHR binding peptide comprises a FSHβ 51-65 peptide. In another embodiment, the FSHR binding peptide comprises a FSHβ 81-95 peptide.

The FSHR binding peptide can include any fragment or a FSH molecule. In certain embodiments, the FSHR binding peptide comprises at least 10 amino acids of the FSH molecule. The FSHR binding peptide can, include, at least about 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more amino acids of a FSH molecule. In certain embodiments, the FSHR binding peptide can be about 6 to about 50 amino acids, about 10 to about 45 amino acids, about 15 to about 40 amino acids, about 20 to about 35 amino acids, or about 25 to about 30 amino acids of the FSH molecule. The FSHR binding peptide retains the capacity to bind to FSHR.

In certain embodiments, the FSHR binding peptide comprises an amino acid sequence selected from the group consisting of SEQ ID NOs:319-331. In certain embodiments, the FSHR binding peptide has 80%, 81%, 82%, 83%, 84%, 85%, 86%, 87%, 88%, 89%, 90%, 91%, 92%, 93%, 94%, 95%, 96%, 97%, 98%, or 99% identity an amino acid sequence selected from the group consisting of SEQ ID NOs:319-331. In certain embodiments, the FSHR binding peptide has an amino acid sequence selected from the group consisting of SEQ ID NOs:319-331, or a variant thereof comprising up to about 5 (such as about any of 1, 2, 3, 4 or 5) amino acid substitutions.

Dominant Negative Forms of an Inhibitor of a Cell-Mediated Immune Response

An inhibitor of a cell-mediated immune response of the immune cell or precursor cell thereof refers to a molecule that acts to inhibit or suppress the immune response effected by the immune cell or precursor cell thereof. In certain embodiments, the inhibitor of a cell-mediated immune response can, for example, be an immune checkpoint inhibitor.

In certain aspects, provided herein are engineered immune cells that express a CAR comprising a dominant-negative form of an inhibitor of a cell-mediated immune response of the immune cell. By way of a non-limiting example, the dominant negative form of an inhibitor can be a receptor that functions in an immune checkpoint inhibitor pathway Immune checkpoint pathways can suppress the immune response of an immune cell. The pathways can deliver negative signals to the immune cells and attenuate TCR-mediated signals, which can lead to decreased cell proliferation, cytokine production and cell cycle progression (Pardoll, Nat. Rev. 12:252-64 (2012); Wu et al., Int. J. Biol. Sci. 8:1420-30 (2012)). Examples of immune checkpoint inhibitor pathway receptors can include, but are not limited to, PD-1, CTLA-4, BTLA, TIM-3, LAG-3, CD160, TIGIT, LAIR1, 2B4, and the like (Chen et al., Nat. Rev. Immunol. 13(4):227-42 (2013)). The corresponding ligands for these receptors include, for example, PD-L1 (for PD-1); PD-L2 (for PD-1); CD80, CD86 (for CTLA-4); HVEM (for BTLA); Galectin-9, HMGB1 (for TIM-3); MHCII (for LAG-3); HVEM (for CD160); CD155, CD112, CD113 (for TIGIT); C1q, collagen (for LAIR1); CD48 (for 2B4), and the like (Chen et al., Nat. Rev. Immunol. 13(4):227-42 (2013)). Expression of a dominant negative form in the immune cell provides for inhibition of a checkpoint inhibitor pathway that is intrinsic to the cell.

In certain embodiments, the dominant negative form of an inhibitor of a cell-mediated immune response of the immune cell is a dominant negative transforming growth factor-β receptor type II (dnTGFβRII). A TGF-β receptor type II can have an amino acid sequence corresponding to GenBank No. NP_001020018.1 or fragments thereof. The domains of the TGFβRII include a signal peptide (amino acids 1-22), an extracellular domain (amino acids 23-191), a transmembrane domain (amino acids 192-212), and an intracellular domain (amino acids 213-592) (see, e.g., GenBank No. NP_001020018.1).

In certain embodiments, the CAR comprises a dominant negative form of TGFβRII (dnTGFβRII). In one embodiment, the dnTGFβRII comprises an extracellular ligand binding domain of TGFβRII. In one embodiment, the dnTGFβRII comprises the extracellular ligand binding domain and a transmembrane domain. In another embodiment, the dnTGFβRII comprises the extracellular ligand binding domain of TGFβRII, a transmembrane domain and a signal peptide.

dnTGFβRII forms have been described previously (see, e.g., Bottinger et al., EMBO J 16:2621-33 (1997); Foster et al., J. Immunother. 31:500-5 (2008); Bollard et al., Blood 99:3179-87 (2002); Wieser et al., Mol. Cell. Biol. 13:7239-47 (1993)). In certain embodiments, the dnTGFβRII comprises the amino acid sequence of SEQ ID NO:347.

The isolated polynucleotide comprising the first nucleotide sequence encoding a CAR and the third nucleotide sequence encoding a dnTGFβRII, can, for example have the first nucleotide sequence connected to the third nucleotide sequence via a third nucleotide sequence encoding a 2A peptide. The 2A peptide is typically 16-20 amino acids in sequence, for example, P2A. When the 2A peptide is encoded between two open reading frames in a multicistronic mRNA, it causes the ribosome to halt at the carboxy-terminus of the 2A peptide in the translating polypeptide, thus resulting in the separation of the polypeptides derived from each open reading frame. The separation point is at the carboxy-terminus of the 2A peptide, with the first amino acid of the downstream open reading frame being a proline. 2A peptides are described, for example, in International Patent Publication No. WO2017/040815.

Polynucleotides, Vectors, and Host Cells

In another general aspect, the invention relates to an isolated nucleic acid encoding a chimeric antigen receptor (CAR) and/or an antibody or antigen-binding fragment thereof of the invention. It will be appreciated by those skilled in the art that the coding sequence of a protein can be changed (e.g., replaced, deleted, inserted, etc.) without changing the amino acid sequence of the protein. Accordingly, it will be understood by those skilled in the art that nucleic acid sequences encoding CARS and/or antibodies or antigen-binding fragments thereof of the invention can be altered without changing the amino acid sequences of the proteins.

In another general aspect, the invention relates to a vector comprising a CAR and/or an isolated nucleic acid encoding the antibody or antigen-binding fragment thereof of the invention. Any vector known to those skilled in the art in view of the present disclosure can be used, such as a plasmid, a cosmid, a phage vector or a viral vector. In some embodiments, the vector is a recombinant expression vector such as a plasmid. The vector can include any element to establish a conventional function of an expression vector, for example, a promoter, ribosome binding element, terminator, enhancer, selection marker, and origin of replication. The promoter can be a constitutive, inducible, or repressible promoter. A number of expression vectors capable of delivering nucleic acids to a cell are known in the art and can be used herein for production of a CAR and/or an antibody or antigen-binding fragment thereof in the cell. Conventional cloning techniques or artificial gene synthesis can be used to generate a recombinant expression vector according to embodiments of the invention.

In another general aspect, the invention relates to a host cell comprising a vector of the invention and/or an isolated nucleic acid encoding a CAR and/or an antibody or antigen-binding fragment thereof of the invention. Any host cell known to those skilled in the art in view of the present disclosure can be used for recombinant expression of CARs and/or antibodies or antigen-binding fragments thereof of the invention. Suitable host cells include prokaryotes, yeast, mammalian cells, or bacterial cells. In some embodiments, the host cells are *E. coli* TG1 or BL21 cells (for expression of, e.g., a CAR, a scFv, or sdAb), CHO-DG44 or CHO-K1 cells or HEK293 cells (for expression of, e.g., a full-length IgG antibody). According to particular embodiments, the recombinant expression vector is transformed into host cells by conventional methods such as chemical transfection, heat shock, or electroporation, where it is stably integrated into the host cell genome such that the recombinant nucleic acid is effectively expressed.

Pharmaceutical Compositions

In another general aspect, the invention relates to a pharmaceutical composition comprising an isolated polynucleotide of the invention, an isolated polypeptide of the invention, a host cell of the invention, an engineered immune cell of the invention, and/or an antibody or antigen binding fragment thereof of the invention and a pharmaceutically acceptable carrier. The term "pharmaceutical composition" as used herein means a product comprising an isolated polynucleotide of the invention, an isolated polypeptide of the invention, a host cell of the invention, and/or an engineered immune cell of the invention together with a pharmaceutically acceptable carrier. Polynucleotides, polypeptides, host cells, engineered immune cells, and/or antibodies or antigen binding fragments of the invention and compositions comprising them are also useful in the manufacture of a medicament for therapeutic applications mentioned herein.

As used herein, the term "carrier" refers to any excipient, diluent, filler, salt, buffer, stabilizer, solubilizer, oil, lipid, lipid containing vesicle, microsphere, liposomal encapsulation, or other material well known in the art for use in pharmaceutical formulations. It will be understood that the characteristics of the carrier, excipient or diluent will depend on the route of administration for a particular application. As used herein, the term "pharmaceutically acceptable carrier" refers to a non-toxic material that does not interfere with the effectiveness of a composition according to the invention or the biological activity of a composition according to the invention. According to particular embodiments, in view of the present disclosure, any pharmaceutically acceptable carrier suitable for use in a polynucleotide, polypeptide, host cell, engineered immune cell, and/or antibody pharmaceutical composition can be used in the invention.

The formulation of pharmaceutically active ingredients with pharmaceutically acceptable carriers is known in the art, e.g., Remington: The Science and Practice of Pharmacy (e.g. 21st edition (2005), and any later editions). Non-limiting examples of additional ingredients include: buffers, diluents, solvents, tonicity regulating agents, preservatives, stabilizers, and chelating agents. One or more pharmaceutically acceptable carrier may be used in formulating the pharmaceutical compositions of the invention.

Methods of Use

In another general aspect, the invention relates to a method of treating a cancer in a subject in need thereof. The methods comprise administering to the subject in need thereof a therapeutically effective amount of an isolated polynucleotide, an isolated polypeptide, a host cell, an engineered immune cell, an antibody or antigen binding fragment thereof, and/or a pharmaceutical composition of the invention. The cancer, can, for example, be selected from an ovarian cancer, a primary peritoneal carcinoma, a pancreatic ductal adenocarcinoma (PDA), a malignant pleural mesothelioma (MPM), a lung adenocarcinoma, a triple negative breast cancer, an endometrial cancer, a biliary cancer, a gastric cancer, or a pediatric acute myeloid leukemia.

According to embodiments of the invention, the pharmaceutical composition comprises a therapeutically effective amount of an isolated polynucleotide, an isolated polypeptide, a host cell, an engineered immune cell, and/or an antibody or antigen binding fragment. As used herein, the term "therapeutically effective amount" refers to an amount of an active ingredient or component that elicits the desired biological or medicinal response in a subject. A therapeutically effective amount can be determined empirically and in a routine manner, in relation to the stated purpose.

As used herein with reference to an isolated polynucleotide, an isolated polypeptide, a host cell, an engineered immune cell, an antibody or antigen binding fragment, and/or a pharmaceutical composition of the invention a therapeutically effective amount means an amount of the isolated polynucleotide, the isolated polypeptide, the host cell, the engineered immune cell, the antibody or antigen binding fragment, and/or the pharmaceutical composition that modulates an immune response in a subject in need thereof.

According to particular embodiments, a therapeutically effective amount refers to the amount of therapy which is sufficient to achieve one, two, three, four, or more of the following effects: (i) reduce or ameliorate the severity of the disease, disorder or condition to be treated or a symptom associated therewith; (ii) reduce the duration of the disease, disorder or condition to be treated, or a symptom associated therewith; (iii) prevent the progression of the disease, disorder or condition to be treated, or a symptom associated therewith; (iv) cause regression of the disease, disorder or condition to be treated, or a symptom associated therewith; (v) prevent the development or onset of the disease, disorder or condition to be treated, or a symptom associated therewith; (vi) prevent the recurrence of the disease, disorder or condition to be treated, or a symptom associated therewith; (vii) reduce hospitalization of a subject having the disease, disorder or condition to be treated, or a symptom associated therewith; (viii) reduce hospitalization length of a subject having the disease, disorder or condition to be treated, or a symptom associated therewith; (ix) increase the survival of a subject with the disease, disorder or condition to be treated, or a symptom associated therewith; (xi) inhibit or reduce the disease, disorder or condition to be treated, or a symptom associated therewith in a subject; and/or (xii) enhance or improve the prophylactic or therapeutic effect(s) of another therapy.

The therapeutically effective amount or dosage can vary according to various factors, such as the disease, disorder or condition to be treated, the means of administration, the target site, the physiological state of the subject (including, e.g., age, body weight, health), whether the subject is a human or an animal, other medications administered, and whether the treatment is prophylactic or therapeutic. Treatment dosages are optimally titrated to optimize safety and efficacy.

According to particular embodiments, the compositions described herein are formulated to be suitable for the intended route of administration to a subject. For example, the compositions described herein can be formulated to be suitable for intravenous, subcutaneous, or intramuscular administration.

The cells of the invention can be administered in any convenient manner known to those skilled in the art. For example, the cells of the invention can be administered to the subject by aerosol inhalation, injection, ingestion, transfusion, implantation, and/or transplantation. The compositions comprising the cells of the invention can be administered transarterially, subcutaneously, intradermaly, intratumorally, intranodally, intramedullary, intramuscularly, inrapleurally, by intravenous (i.v.) injection, or intraperitoneally. In certain embodiments, the cells of the invention can be administered with or without lymphodepletion of the subject.

The pharmaceutical compositions comprising cells of the invention expressing CARs of the invention can be provided in sterile liquid preparations, typically isotonic aqueous solutions with cell suspensions, or optionally as emulsions, dispersions, or the like, which are typically buffered to a selected pH. The compositions can comprise carriers, for example, water, saline, phosphate buffered saline, and the like, suitable for the integrity and viability of the cells, and for administration of a cell composition.

Sterile injectable solutions can be prepared by incorporating cells of the invention in a suitable amount of the appropriate solvent with various other ingredients, as desired. Such compositions can include a pharmaceutically acceptable carrier, diluent, or excipient such as sterile water, physiological saline, glucose, dextrose, or the like, that are suitable for use with a cell composition and for administration to a subject, such as a human. Suitable buffers for providing a cell composition are well known in the art. Any vehicle, diluent, or additive used is compatible with preserving the integrity and viability of the cells of the invention.

The cells of the invention can be administered in any physiologically acceptable vehicle. A cell population comprising cells of the invention can comprise a purified population of cells. Those skilled in the art can readily determine the cells in a cell population using various well known methods. The ranges in purity in cell populations comprising genetically modified cells of the invention can be from about 50% to about 55%, from about 55% to about 60%, from about 60% to about 65%, from about 65% to about 70%, from about 70% to about 75%, from about 75% to about 80%, from about 80% to about 85%, from about 85% to about 90%, from about 90% to about 95%, or from about 95% to about 100%. Dosages can be readily adjusted by those skilled in the art, for example, a decrease in purity could require an increase in dosage.

The cells of the invention are generally administered as a dose based on cells per kilogram (cells/kg) of body weight of the subject to which the cells are administered. Generally, the cell doses are in the range of about $10^4$ to about $10^{10}$ cells/kg of body weight, for example, about $10^5$ to about $10^9$, about $10^5$ to about $10^8$, about $10^5$ to about $10^7$, or about $10^5$ to about $10^6$, depending on the mode and location of administration. In general, in the case of systemic administration, a higher dose is used than in regional administration, where the immune cells of the invention are administered in the region of a tumor and/or cancer. Additionally, the dose can be adjusted to account for whether a single dose is being administered or whether multiple doses are being administered. The precise determination of what would be considered an effective dose can be based on factors individual to each subject.

As used herein, the terms "treat," "treating," and "treatment" are all intended to refer to an amelioration or reversal of at least one measurable physical parameter related to a cancer, which is not necessarily discernible in the subject, but can be discernible in the subject. The terms "treat," "treating," and "treatment," can also refer to causing regression, preventing the progression, or at least slowing down the progression of the disease, disorder, or condition. In a particular embodiment, "treat," "treating," and "treatment" refer to an alleviation, prevention of the development or onset, or reduction in the duration of one or more symptoms associated with the disease, disorder, or condition, such as a tumor or more preferably a cancer. In a particular embodiment, "treat," "treating," and "treatment" refer to prevention of the recurrence of the disease, disorder, or condition. In a particular embodiment, "treat," "treating," and "treatment" refer to an increase in the survival of a subject having the disease, disorder, or condition. In a particular embodiment, "treat," "treating," and "treatment" refer to elimination of the disease, disorder, or condition in the subject.

EMBODIMENTS

This invention provides the following non-limiting embodiments.

Embodiment 1 an isolated polynucleotide comprising a nucleotide sequence encoding a chimeric antigen receptor (CAR), wherein the CAR comprises:
 (a) an extracellular domain comprising a first polypeptide that binds specifically to a follicle-stimulating hormone receptor (FSHR), and an antigen binding fragment that binds specifically to a tumor antigen;
 (b) a transmembrane domain; and
 (c) an intracellular signaling domain,
wherein the CAR optionally further comprises a signal peptide at its amino terminus and a hinge region connecting the extracellular domain and the transmembrane domain.

Embodiment 1a is the isolated polynucleotide of embodiment 1, wherein the first polypeptide is an antigen binding fragment that binds specifically to the FSHR, preferably a human FSHR.

Embodiment 1b is the isolated polynucleotide of embodiment 1a, wherein the first polypeptide that binds specifically to the FSHR comprises a Fab, a Fab', a F(ab')$_2$, an Fv, a single-chain variable fragment (scFv), a minibody, a diabody, a single-domain antibody (sdAb), a light chain variable domain ($V_L$), a heavy chain only antibody, or a variable domain ($V_HH$) of a camelid antibody.

Embodiment 2 is the isolated polynucleotide of embodiment 1, wherein the first polypeptide comprises an amino acid sequence selected from the group consisting of SEQ ID NOs:319-331.

Embodiment 3 is the isolated polynucleotide of any one of embodiments 1 to 2, wherein the first polypeptide is connected to the amino terminus of the antigen binding fragment via a linker.

Embodiment 3a is the isolated polynucleotide of embodiment 1 or 2, wherein the first polypeptide is connected to the carboxy terminus of the antigen binding fragment via a linker.

Embodiment 4 is the isolated polynucleotide of any one of embodiments 1 to 3a, wherein the tumor antigen is selected from the group consisting of mesothelin, folate receptor α, mucin 16 (MUC16), prostate-specific membrane antigen (PSMA), human epidermal growth factor receptor 2 (HER2), epidermal growth factor receptor (EGFR), and vascular endothelial growth factor receptor (VEGFR).

Embodiment 5 is the isolated polynucleotide of embodiment 4, wherein the tumor antigen is mesothelin, preferably human mesothelin.

Embodiment 5a is the isolated polynucleotide of embodiment 4, wherein the tumor antigen is MUC16, preferably human MUC16.

Embodiment 5b is the isolated polynucleotide of embodiment 4, wherein the tumor antigen is PSMA, preferably human PSMA.

Embodiment 5c is the isolated polynucleotide of embodiment 4, wherein the tumor antigen is HER2, preferably human HER2.

Embodiment 5d is the isolated polynucleotide of embodiment 4, wherein the tumor antigen is EGFR, preferably human EGFR.

Embodiment 5e is the isolated polynucleotide of embodiment 4, wherein the tumor antigen is VEGFR, preferably human VEGFR.

Embodiment 6 is the isolated polynucleotide of any one of embodiments 5 to 5e, wherein the antigen binding fragment is a Fab, a Fab', a F(ab')$_2$, an Fv, a single-chain variable fragment (scFv), a minibody, a diabody, a single-domain antibody (sdAb), a light chain variable domain (VL), a heavy chain only antibody, or a variable domain (V$_H$H) of a camelid antibody.

Embodiment 6a is the isolated polynucleotide of embodiment 6, wherein the antigen binding fragment is a Fab.

Embodiment 6b is the isolated polynucleotide of embodiment 6, wherein the antigen binding fragment is a Fab'.

Embodiment 6c is the isolated polynucleotide of embodiment 6, wherein the antigen binding fragment is a F(ab')$_2$.

Embodiment 6d is the isolated polynucleotide of embodiment 6, wherein the antigen binding fragment is a Fv.

Embodiment 6e is the isolated polynucleotide of embodiment 6, wherein the antigen binding fragment is a scFv.

Embodiment 6f is the isolated polynucleotide of embodiment 6, wherein the antigen binding fragment is a minibody.

Embodiment 6g is the isolated polynucleotide of embodiment 6, wherein the antigen binding fragment is a diabody.

Embodiment 6h is the isolated polynucleotide of embodiment 6, wherein the antigen binding fragment is a sdAb.

Embodiment 6i is the isolated polynucleotide of embodiment 6, wherein the antigen binding fragment is a VL.

Embodiment 6j is the isolated polynucleotide of embodiment 6, wherein the antigen binding fragment is a heavy chain only antibody.

Embodiment 6k is the isolated polynucleotide of embodiment 6, wherein the antigen binding fragment is a V$_H$H of a camelid antibody.

Embodiment 7 is the isolated polynucleotide of any one of embodiments 6 to 6k, wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
    a. SEQ ID NOs:1, 69, 137, 2, 70, and 138, respectively;
    b. SEQ ID NOs:19, 87, 155, 20, 88, and 156, respectively;
    c. SEQ ID NOs:23, 91, 159, 24, 92, and 160, respectively;
    d. SEQ ID NOs:25, 93, 161, 26, 94, and 162, respectively;
    e. SEQ ID NOs:27, 95, 163, 28, 96, and 164, respectively;
    f. SEQ ID NOs:29, 97, 165, 30, 98, and 166, respectively;
    g. SEQ ID NOs:3, 71, 139, 4, 72, and 140, respectively;
    h. SEQ ID NOs:5, 73, 141, 6, 74, and 142, respectively;
    i. SEQ ID NOs:7, 75, 143, 8, 76, and 144, respectively;
    j. SEQ ID NOs:9, 77, 145, 10, 78, and 146, respectively;
    k. SEQ ID NOs:11, 79, 147, 12, 80, and 148, respectively;
    l. SEQ ID NOs:13, 81, 149, 14, 82, and 150, respectively;
    m. SEQ ID NOs:15, 83, 151, 16, 84, and 152, respectively;

n. SEQ ID NOs:17, 85, 153, 18, 86, and 154, respectively;
o. SEQ ID NOs:21, 89, 157, 22, 90, and 158, respectively, or a variant thereof comprising up to about 3 (such as about any of 1, 2, or 3) amino acid substitutions in the CDR regions.

Embodiment 7a is the isolated polynucleotide of any one of embodiments 6 to 6k, wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
    a. SEQ ID NOs:1, 69, 137, 2, 70, and 138, respectively;
    b. SEQ ID NOs:19, 87, 155, 20, 88, and 156, respectively;
    c. SEQ ID NOs:23, 91, 159, 24, 92, and 160, respectively;
    d. SEQ ID NOs:25, 93, 161, 26, 94, and 162, respectively;
    e. SEQ ID NOs:27, 95, 163, 28, 96, and 164, respectively;
    f. SEQ ID NOs:29, 97, 165, 30, 98, and 166, respectively;
    g. SEQ ID NOs:3, 71, 139, 4, 72, and 140, respectively;
    h. SEQ ID NOs:5, 73, 141, 6, 74, and 142, respectively;
    i. SEQ ID NOs:7, 75, 143, 8, 76, and 144, respectively;
    j. SEQ ID NOs:9, 77, 145, 10, 78, and 146, respectively;
    k. SEQ ID NOs:11, 79, 147, 12, 80, and 148, respectively;
    l. SEQ ID NOs:13, 81, 149, 14, 82, and 150, respectively;
    m. SEQ ID NOs:15, 83, 151, 16, 84, and 152, respectively;
    n. SEQ ID NOs:17, 85, 153, 18, 86, and 154, respectively; or
    o. SEQ ID NOs:21, 89, 157, 22, 90, and 158, respectively.

Embodiment 8 is the isolated polynucleotide of embodiment 7 or 7a, wherein the antigen binding fragment comprises:
  i. the single domain antibody comprising an amino acid sequence at least 95% identical to an amino acid sequence selected from the group consisting of SEQ ID NOs:221-258 and SEQ ID NOs: 420-428, or a variant thereof, preferably the variant comprises one, two, three or more amino acid substitutions, deletions and/or insertions; or
  ii. the single chain variable fragment comprising an amino acid sequence at least 95% identical to an amino acid sequence selected from the group consisting of SEQ ID NOs:205-220, or a variant thereof, preferably the variant comprises one, two, three or more amino acid substitutions, deletions and/or insertions.

Embodiment 8a is the isolated polynucleotide of embodiment 7 or 7a, wherein the antigen binding fragment comprises:
  i. the single domain antibody comprising an amino acid sequence selected from the group consisting of SEQ ID NOs:221-258 and SEQ ID NOs: 420-428, or a variant thereof comprising one, two, three or more amino acid substitutions, deletions and/or insertions; or
  ii. the single chain variable fragment comprising an amino acid sequence selected from the group consisting of SEQ ID NOs:205-220, or a variant thereof, preferably the variant comprises one, two, three or more amino acid substitutions, deletions and/or insertions.

Embodiment 8b is the isolated polynucleotide of embodiment 7 or 7a, wherein the antigen binding fragment comprises:
  i. the single domain antibody comprising an amino acid sequence selected from the group consisting of SEQ ID NOs:221-258 and SEQ ID NOs: 420-428; or
  ii. the single chain variable fragment comprising an amino acid sequence selected from the group consisting of SEQ ID NOs:205-220.

Embodiment 9 is the isolated polynucleotide of any one of embodiments 1 to 8b, wherein the extracellular domain comprises an amino acid sequence selected from the group consisting of SEQ ID NOs:348-357.

Embodiment 10 is an isolated polynucleotide comprising a nucleotide sequence encoding a chimeric antigen receptor (CAR), wherein the CAR comprises:
  (a) an extracellular domain comprising an antigen binding fragment that binds specifically to mesothelin, preferably human mesothelin;
  (b) a transmembrane domain; and
  (c) an intracellular signaling domain,
wherein the CAR optionally further comprises a signal peptide at the amino terminus and a hinge region connecting the extracellular domain and the transmembrane domain, and wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
    a. SEQ ID NOs:1, 69, 137, 2, 70, and 138, respectively;
    b. SEQ ID NOs:19, 87, 155, 20, 88, and 156, respectively;
    c. SEQ ID NOs:23, 91, 159, 24, 92, and 160, respectively;
    d. SEQ ID NOs:25, 93, 161, 26, 94, and 162, respectively;
    e. SEQ ID NOs:27, 95, 163, 28, 96, and 164, respectively;
    f. SEQ ID NOs:29, 97, 165, 30, 98, and 166, respectively;
    g. SEQ ID NOs:3, 71, 139, 4, 72, and 140, respectively;
    h. SEQ ID NOs:5, 73, 141, 6, 74, and 142, respectively;
    i. SEQ ID NOs:7, 75, 143, 8, 76, and 144, respectively;
    j. SEQ ID NOs:9, 77, 145, 10, 78, and 146, respectively;
    k. SEQ ID NOs:11, 79, 147, 12, 80, and 148, respectively;
    l. SEQ ID NOs:13, 81, 149, 14, 82, and 150, respectively;
    m. SEQ ID NOs:15, 83, 151, 16, 84, and 152, respectively;
    n. SEQ ID NOs:17, 85, 153, 18, 86, and 154, respectively;
    o. SEQ ID NOs:21, 89, 157, 22, 90, and 158, respectively, or
  a variant thereof comprising up to about 3 (such as about any of 1, 2, or 3) amino acid substitutions in the CDR regions.

Embodiment 10a is an isolated polynucleotide comprising a nucleotide sequence encoding a chimeric antigen receptor (CAR), wherein the CAR comprises:
  (a) an extracellular domain comprising an antigen binding fragment that binds specifically to mesothelin, preferably human mesothelin;
  (b) a transmembrane domain; and
  (c) an intracellular signaling domain,
wherein the CAR optionally further comprises a signal peptide at the amino terminus and a hinge region connecting the extracellular domain and the transmembrane domain, and wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
a. SEQ ID NOs:1, 69, 137, 2, 70, and 138, respectively;
b. SEQ ID NOs:19, 87, 155, 20, 88, and 156, respectively;
c. SEQ ID NOs:23, 91, 159, 24, 92, and 160, respectively;
d. SEQ ID NOs:25, 93, 161, 26, 94, and 162, respectively;
e. SEQ ID NOs:27, 95, 163, 28, 96, and 164, respectively;
f. SEQ ID NOs:29, 97, 165, 30, 98, and 166, respectively;
g. SEQ ID NOs:3, 71, 139, 4, 72, and 140, respectively;
h. SEQ ID NOs:5, 73, 141, 6, 74, and 142, respectively;
i. SEQ ID NOs:7, 75, 143, 8, 76, and 144, respectively;
j. SEQ ID NOs:9, 77, 145, 10, 78, and 146, respectively;
k. SEQ ID NOs:11, 79, 147, 12, 80, and 148, respectively;
l. SEQ ID NOs:13, 81, 149, 14, 82, and 150, respectively;
m. SEQ ID NOs:15, 83, 151, 16, 84, and 152, respectively;
n. SEQ ID NOs:17, 85, 153, 18, 86, and 154, respectively; or
o. SEQ ID NOs:21, 89, 157, 22, 90, and 158, respectively.

Embodiment 11 is the isolated polynucleotide of embodiment 10 or 10a, wherein the antigen binding fragment is
i. the single domain antibody comprising an amino acid sequence at least 95% identical to an amino acid sequence selected from the group consisting of SEQ ID NOs:221-258 and SEQ ID NOs: 420-428, or a variant thereof, preferably the variant comprises one, two, three or more amino acid substitutions, deletions and/or insertions, or
ii. the single chain variable fragment comprising an amino acid sequence at least 95% identical to an amino acid sequence selected from the group consisting of SEQ ID NOs:205-220 or a variant thereof, preferably the variant comprises one, two, three or more amino acid substitutions, deletions and/or insertions.

Embodiment 11a is the isolated polynucleotide of embodiment 10 or 10a, wherein the antigen binding fragment comprises:
i. the single domain antibody comprising an amino acid sequence selected from the group consisting of SEQ ID NOs:221-258 and SEQ ID NOs: 420-428, or a variant thereof comprising one, two, three or more amino acid substitutions, deletions and/or insertions; or
ii. the single chain variable fragment comprising an amino acid sequence selected from the group consisting of SEQ ID NOs:205-220, or a variant thereof, preferably the variant comprises one, two, three or more amino acid substitutions, deletions and/or insertions.

Embodiment 11b is the isolated polynucleotide of embodiment 10 or 10a, wherein the antigen binding fragment comprises:
i. the single domain antibody comprising an amino acid sequence selected from the group consisting of SEQ ID NOs:221-258 and SEQ ID NOs: 420-428; or
ii. the single chain variable fragment comprising an amino acid sequence selected from the group consisting of SEQ ID NOs:205-220.

Embodiment 12 is the isolated polynucleotide of any one of embodiments 10 to 11b, wherein the polynucleotide further comprises a second nucleotide sequence encoding a second chimeric antigen receptor (CAR), wherein the second CAR comprises:
(a) an extracellular domain comprising a polypeptide that binds specifically to a follicle-stimulating hormone receptor (FSHR);
(b) a transmembrane domain; and
(c) an intracellular signaling domain,
wherein the second CAR optionally further comprises a signal peptide at the amino terminus and a hinge region connecting the extracellular domain and the transmembrane domain.

Embodiment 12a is the isolated polynucleotide of embodiment 12, wherein the nucleotide sequence encoding the CAR is connected to the second nucleotide sequence via a 2A peptide coding sequence.

Embodiment 12b is the isolated polynucleotide of embodiment 12 or 12a, wherein the 3'-end of the nucleotide sequence encoding the CAR is connected to the 5'-end of the second nucleotide sequence.

Embodiment 12c is the isolated polynucleotide of embodiment 12 or 12a, wherein the 3'-end of the second nucleotide sequence is connected to the 5'-end of the nucleotide sequence encoding the CAR.

Embodiment 12d is the isolated polynucleotide of any one of embodiment 12 to 12c, wherein the polypeptide that binds specifically to an FSHR is an antigen binding fragment that binds specifically to the FSHR, preferably a human FSHR.

Embodiment 12e is the isolated polynucleotide of embodiment 12d, wherein the antigen binding fragment that binds specifically to the FSHR is a Fab, a Fab', a F(ab')$_2$, an Fv, a single-chain variable fragment (scFv), a minibody, a diabody, a single-domain antibody (sdAb), a light chain variable domain (VL), a heavy chain only antibody, or a variable domain (V$_H$H) of a camelid antibody.

Embodiment 13 is the isolated polynucleotide of any one of embodiments 12 to 12d, wherein the polypeptide that binds specifically to FSHR comprises an amino acid sequence selected from the group consisting of SEQ ID NOs:319-331.

Embodiment 14 is the isolated polynucleotide of any one of embodiments 1-13, wherein the CAR comprises a signal peptide having an amino acid sequence that is at least 90% identical to SEQ ID NO:340.

Embodiment 14a is the isolated polynucleotide of any one of embodiments 12-14, wherein the second CAR comprises a signal peptide having an amino acid sequence that is at least 90% identical to SEQ ID NO:340.

Embodiment 14b is the isolated polynucleotide of embodiment 14 or 14a, wherein the CAR and the second CAR comprise the same signal sequence.

Embodiment 14c is the isolated polynucleotide of embodiment 14 or 14a, wherein the CAR and the second CAR comprise different signal sequences.

Embodiment 15 is the isolated polynucleotide of any one of embodiments 1-14c, wherein the CAR comprises a hinge region having an amino acid sequence that is at least 90% identical to SEQ ID NO:341.

Embodiment 15a is the isolated polynucleotide of any one of embodiments 12-15, wherein the second CAR comprises a hinge region having an amino acid sequence that is at least 90% identical to SEQ ID NO:341.

Embodiment 15b is the isolated polynucleotide of embodiment 15 or 15a, wherein the CAR and the second CAR comprise the same hinge region.

Embodiment 15c is the isolated polynucleotide of embodiment 15 or 15a, wherein the CAR and the second CAR comprise different hinge region.

Embodiment 16 is the isolated polynucleotide of any one of embodiments 1-15c, wherein the CAR comprises a transmembrane domain selected from the group consisting of a CD8α transmembrane domain, a CD28 transmembrane domain, a CD4 transmembrane domain, a CD3ζ transmembrane domain, a CD2 transmembrane domain, a 4-1BB transmembrane domain, an OX40 transmembrane domain, an ICOS transmembrane domain, a CTLA-4 transmembrane domain, a PD-1 transmembrane domain, a LAG-3 transmembrane domain, a 2B4 transmembrane domain, a BTLA transmembrane domain, and a GMCSFR transmembrane domain.

Embodiment 16a is the isolated polynucleotide of any one of embodiments 12-16, wherein the second CAR comprises a transmembrane domain selected from the group consisting of a CD8α transmembrane domain, a CD28 transmembrane domain, a CD4 transmembrane domain, a CD3ζ transmembrane domain, a CD2 transmembrane domain, a 4-1BB transmembrane domain, an OX40 transmembrane domain, an ICOS transmembrane domain, a CTLA-4 transmembrane domain, a PD-1 transmembrane domain, a LAG-3 transmembrane domain, a 2B4 transmembrane domain, a BTLA transmembrane domain, and a GMCSFR transmembrane domain.

Embodiment 16b is the isolated polynucleotide of embodiment 16 or 16a, wherein the CAR and the second CAR comprise the same transmembrane domain.

Embodiment 16c is the isolated polynucleotide of embodiment 16 or 16a, wherein the CAR and the second CAR comprise different transmembrane domain.

Embodiment 17 is the isolated polynucleotide of any one of embodiments 1-16c, wherein the CAR comprises an intracellular signaling domain selected from the group consisting of a signaling domain of CD3ζ, FcRγ, FcRβ, CD3γ, CD3δ, CD3ε, CD5, CD22, CD79α, CD79β, and CD66δ.

Embodiment 17a is the isolated polynucleotide of any one of embodiments 12-17, wherein the second CAR comprises an intracellular signaling domain selected from the group consisting of a signaling domain of CD3ζ, FcRγ, FcRβ, CD3γ, CD3δ, CD3ε, CD5, CD22, CD79α, CD79β, and CD66δ.

Embodiment 17b is the isolated polynucleotide of embodiment 17 or 17a, wherein the CAR and the second CAR comprise the same intracellular signaling domain.

Embodiment 17c is the isolated polynucleotide of embodiment 17 or 17a, wherein the CAR and the second CAR comprise different intracellular signaling domain.

Embodiment 18 is the isolated polynucleotide of embodiment 17, wherein the CAR comprises a co-stimulatory domain selected from the group consisting of a co-stimulatory domain of one or more of CD28, 4-1BB (CD137), CD27, OX40, CD27, CD40, PD-1, ICOS, lymphocyte function-associated antigen-1 (LFA-1), CD2, CD7, LIGHT, NKG2C, B7-H3, TNFRSF9, TNFRSF4, TNFRSF8, CD40LG, ITGB2, KLRC2, TNFRSF18, TNFRSF14, HAVCR1, LGALS9, CD83, and a ligand that specifically binds with CD83.

Embodiment 18a is the isolated polynucleotide of any one of embodiments 12-17, wherein the second CAR comprises a co-stimulatory domain selected from the group consisting of a co-stimulatory domain of one or more of CD28, 4-1BB (CD137), CD27, OX40, CD27, CD40, PD-1, ICOS, lymphocyte function-associated antigen-1 (LFA-1), CD2, CD7, LIGHT, NKG2C, B7-H3, TNFRSF9, TNFRSF4, TNFRSF8, CD40LG, ITGB2, KLRC2, TNFRSF18, TNFRSF14, HAVCR1, LGALS9, CD83, and a ligand that specifically binds with CD83.

Embodiment 18b is the isolated polynucleotide of embodiment 18 or 18a, wherein the CAR and the second CAR comprise the same co-stimulatory domain.

Embodiment 18c is the isolated polynucleotide of embodiment 18 or 18a, wherein the CAR and the second CAR comprise different co-stimulatory domain.

Embodiment 19 is the isolated polynucleotide of embodiment 1, wherein the CAR comprises an amino acid sequence selected from the group consisting of SEQ ID NOs:370-379 and SEQ ID NOs: 448-450.

Embodiment 20 is the isolated polynucleotide of embodiment 10, wherein the CAR comprises an amino acid sequence selected from the group consisting of SEQ ID NOs:358-367 and SEQ ID NOs: 445-447.

Embodiment 20 is the isolated polynucleotide of embodiment 10, encoding a protein having an amino acid sequence selected from the group consisting of SEQ ID NOs: 380-389 and SEQ ID NOs:451-453.

Embodiment 21 is the isolated polynucleotide of any one of embodiments 1-20, further comprising a third nucleotide sequence encoding a dominant negative form of an inhibitor of a cell-mediated immune response of the immune cell.

Embodiment 22 is the isolated polynucleotide of embodiment 21, wherein the inhibitor of a cell-mediated immune response of the immune cell is a transforming growth factor β (TGF-β) receptor.

Embodiment 23 is the isolated polynucleotide of embodiment 22, wherein the dominant negative form of the inhibitor comprises the amino acid sequence of SEQ ID NO:347.

Embodiment 24 is the isolated polynucleotide of any one of embodiments 21-23, wherein the nucleotide sequence encoding the CAR is connected to the third nucleotide sequence via a 2A peptide coding sequence.

Embodiment 24a is the isolated polynucleotide of embodiment 24, wherein the 3'-end of the nucleotide sequence encoding the CAR is connected to the 5'-end of the third nucleotide sequence.

Embodiment 24b is the isolated polynucleotide of embodiment 24, wherein the 3'-end of the third nucleotide sequence is connected to the 5'-end of the nucleotide sequence encoding the CAR.

Embodiment 24c is the isolated polynucleotide of embodiment 24, wherein the 3'-end of the second nucleotide sequence is connected to the 5'-end of the third nucleotide sequence.

Embodiment 24d is the isolated polynucleotide of embodiment 24, wherein the 3'-end of the third nucleotide sequence is connected to the 5'-end of the second nucleotide sequence.

Embodiment 25 is the isolated polynucleotide of any one of embodiments 24 to 24d, wherein the CAR comprises an amino acid sequence selected from the group consisting of SEQ ID NOs:390-419 and SEQ ID NOs: 460-468.

Embodiment 26 is a vector comprising the polynucleotide of any of embodiments 1-25 and 72-80.

Embodiment 27 is a host cell comprising the polynucleotide of any of claims 1-25 and 72-80 or the vector of embodiment 26.

Embodiment 28 is a method of treating a cancer in a subject in need thereof, comprising administering to the subject a therapeutically effective amount of the host cell of embodiment 27.

Embodiment 29 is an engineered immune cell expressing the CAR encoded by the polynucleotide of any of embodiments 1-25 or a modified TCR comprising the fusion protein encoded by the polypeptide of any of embodiments 72-80.

Embodiment 30 is the engineered immune cell of embodiment 29, wherein the engineered immune cell is selected from the group consisting of a cytotoxic T cell, a helper T cell, a natural killer cell, a γδT cell, and a NKT cell.

Embodiment 31 is a pharmaceutical composition, comprising the engineered immune cell of embodiment 29 or 30 and a pharmaceutically acceptable carrier.

Embodiment 32 is a method of treating a cancer in a subject in need thereof, comprising administering to the subject a therapeutically effective amount of the pharmaceutical composition of embodiment 31.

Embodiment 32a is the method of embodiment 32, wherein the engineered immune cell is autologous.

Embodiment 32b is the method of embodiment 32, wherein the engineered immune cell is allogeneic.

Embodiment 32c is the method of embodiment 32, wherein the engineered immune cell is syngeneic.

Embodiment 33 is the method of any one of embodiments 28, and 32-32c, wherein the cancer is selected from an ovarian cancer, a primary peritoneal carcinoma, a pancreatic ductal adenocarcinoma (PDA), a malignant pleural mesothelioma (MPM), a lung adenocarcinoma, a triple negative breast cancer, an endometrial cancer, a biliary cancer, a gastric cancer, or a pediatric acute myeloid leukemia, preferably an ovarian cancer.

Embodiment 34 is a method of engineering an immune cell, comprising introducing into the immune cell the polynucleotide of any of embodiments 1-25 and 72-80 operably linked to a promoter.

Embodiment 35 is a method of producing a pharmaceutical composition, comprising combining the engineered immune cell of embodiment 29 or 30 with a pharmaceutically acceptable carrier to obtain the pharmaceutical composition.

Embodiment 36 is a system for inducing the activity of an immune cell and/or a target cell, the system comprising an engineered cell comprising a chimeric antigen receptor (CAR), wherein the CAR comprises:
  (a) an extracellular domain comprising a first polypeptide that binds specifically to a follicle-stimulating hormone receptor (FSHR), and an antigen binding fragment that binds specifically to a tumor antigen;
  (b) a transmembrane domain; and
  (c) an intracellular signaling domain,
wherein the CAR optionally further comprises a signal peptide at its amino terminus and a hinge region connecting the extracellular domain and the transmembrane domain.

Embodiment 37 is the system of embodiment 36, wherein the first polypeptide comprises an amino acid sequence selected from the group consisting of SEQ ID NOs:319-331.

Embodiment 38 is the system of embodiment 36 or 37, wherein the first polypeptide is connected to the amino terminus or carboxy terminus of the antigen binding fragment via a linker.

Embodiment 39 is the system of any one of embodiments 36 to 38, wherein the tumor antigen is selected from the group consisting of mesothelin, folate receptor α, mucin 16 (MUC16), prostate-specific membrane antigen (PSMA), human epidermal growth factor receptor 2 (HER2), epidermal growth factor receptor (EGFR), and vascular endothelial growth factor receptor (VEGFR).

Embodiment 40 is the system of any one of embodiments 36 to 39, wherein the tumor antigen is mesothelin, preferably human mesothelin.

Embodiment 41 is the system of embodiment 40, wherein the antigen binding fragment is a Fab, a Fab', a F(ab')$_2$, an Fv, a single-chain variable fragment (scFv), a minibody, a diabody, a single-domain antibody (sdAb), a light chain variable domain (VL), or a variable domain (V$_H$H) of a camelid antibody.

Embodiment 42 is the system of embodiment 41, wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
    a. SEQ ID NOs:1, 69, 137, 2, 70, and 138, respectively;
    b. SEQ ID NOs:19, 87, 155, 20, 88, and 156, respectively;
    c. SEQ ID NOs:23, 91, 159, 24, 92, and 160, respectively;
    d. SEQ ID NOs:25, 93, 161, 26, 94, and 162, respectively;
    e. SEQ ID NOs:27, 95, 163, 28, 96, and 164, respectively;
    f. SEQ ID NOs:29, 97, 165, 30, 98, and 166, respectively;
    g. SEQ ID NOs:3, 71, 139, 4, 72, and 140, respectively;
    h. SEQ ID NOs:5, 73, 141, 6, 74, and 142, respectively;

i. SEQ ID NOs:7, 75, 143, 8, 76, and 144, respectively;
  j. SEQ ID NOs:9, 77, 145, 10, 78, and 146, respectively;
  k. SEQ ID NOs:11, 79, 147, 12, 80, and 148, respectively;
  l. SEQ ID NOs:13, 81, 149, 14, 82, and 150, respectively;
  m. SEQ ID NOs:15, 83, 151, 16, 84, and 152, respectively;
  n. SEQ ID NOs:17, 85, 153, 18, 86, and 154, respectively;
  o. SEQ ID NOs:21, 89, 157, 22, 90, and 158, respectively; or a variant thereof comprising up to about 3 (such as about any of 1, 2, or 3) amino acid substitutions in the CDR regions.

Embodiment 42a is the system of embodiment 41, wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
    a. SEQ ID NOs:1, 69, 137, 2, 70, and 138, respectively;
    b. SEQ ID NOs:19, 87, 155, 20, 88, and 156, respectively;
    c. SEQ ID NOs:23, 91, 159, 24, 92, and 160, respectively;
    d. SEQ ID NOs:25, 93, 161, 26, 94, and 162, respectively;
    e. SEQ ID NOs:27, 95, 163, 28, 96, and 164, respectively;
    f. SEQ ID NOs:29, 97, 165, 30, 98, and 166, respectively;
    g. SEQ ID NOs:3, 71, 139, 4, 72, and 140, respectively;
    h. SEQ ID NOs:5, 73, 141, 6, 74, and 142, respectively;
    i. SEQ ID NOs:7, 75, 143, 8, 76, and 144, respectively;
    j. SEQ ID NOs:9, 77, 145, 10, 78, and 146, respectively;
    k. SEQ ID NOs:11, 79, 147, 12, 80, and 148, respectively;
    l. SEQ ID NOs:13, 81, 149, 14, 82, and 150, respectively;
    m. SEQ ID NOs:15, 83, 151, 16, 84, and 152, respectively;
    n. SEQ ID NOs:17, 85, 153, 18, 86, and 154, respectively; or
    o. SEQ ID NOs:21, 89, 157, 22, 90, and 158, respectively.

Embodiment 43 is the system of embodiment 42 or 42a, wherein the antigen binding fragment comprises:
  i. the single domain antibody comprising an amino acid sequence at least 95% identical to an amino acid sequence selected from the group consisting of SEQ ID NOs:221-258 and SEQ ID NOs: 420-428, or a variant thereof, preferably the variant comprises one, two, three or more amino acid substitutions, deletions and/or insertions, or
  ii. the single chain variable fragment comprising an amino acid sequence at least 95% identical to an amino acid sequence selected from the group consisting of SEQ ID NOs:205-220 or a variant thereof, preferably the variant comprises one, two, three or more amino acid substitutions, deletions and/or insertions.

Embodiment 43a is the isolated polynucleotide of embodiment 42 or 42a, wherein the antigen binding fragment comprises:
  i. the single domain antibody comprising an amino acid sequence selected from the group consisting of SEQ ID NOs:221-258 and SEQ ID NOs: 420-428, or a variant thereof comprising one, two, three or more amino acid substitutions, deletions and/or insertions; or
  ii. the single chain variable fragment comprising an amino acid sequence selected from the group consisting of SEQ ID NOs:205-220, or a variant thereof, preferably the variant comprises one, two, three or more amino acid substitutions, deletions and/or insertions.

Embodiment 43b is the isolated polynucleotide of embodiment 42 or 42a, wherein the antigen binding fragment comprises:
  i. the single domain antibody comprising an amino acid sequence selected from the group consisting of SEQ ID NOs:221-258 and SEQ ID NOs: 420-428; or
  ii. the single chain variable fragment comprising an amino acid sequence selected from the group consisting of SEQ ID NOs:205-220.

Embodiment 44 is the system of any one of embodiments 36 to 43b, wherein the extracellular domain comprises an amino acid sequence selected from the group consisting of SEQ ID NOs:348-357.

Embodiment 45 is a system for inducing activity of an immune cell and/or a target cell, the system comprising an engineered cell comprising a chimeric antigen receptor (CAR), wherein the CAR comprises:
  (a) an extracellular domain comprising an antigen binding fragment that binds specifically to mesothelin, preferably human mesothelin;
  (b) a transmembrane domain; and
  (c) an intracellular signaling domain,
wherein the CAR optionally further comprises a signal peptide at the amino terminus and a hinge region connecting the extracellular domain and the transmembrane domain, and
wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
    a. SEQ ID NOs:1, 69, 137, 2, 70, and 138, respectively;
    b. SEQ ID NOs:19, 87, 155, 20, 88, and 156, respectively;
    c. SEQ ID NOs:23, 91, 159, 24, 92, and 160, respectively;
    d. SEQ ID NOs:25, 93, 161, 26, 94, and 162, respectively;
    e. SEQ ID NOs:27, 95, 163, 28, 96, and 164, respectively;
    f. SEQ ID NOs:29, 97, 165, 30, 98, and 166, respectively;
    g. SEQ ID NOs:3, 71, 139, 4, 72, and 140, respectively;
    h. SEQ ID NOs:5, 73, 141, 6, 74, and 142, respectively;
    i. SEQ ID NOs:7, 75, 143, 8, 76, and 144, respectively;
    j. SEQ ID NOs:9, 77, 145, 10, 78, and 146, respectively;
    k. SEQ ID NOs:11, 79, 147, 12, 80, and 148, respectively;
    l. SEQ ID NOs:13, 81, 149, 14, 82, and 150, respectively;
    m. SEQ ID NOs:15, 83, 151, 16, 84, and 152, respectively;
    n. SEQ ID NOs:17, 85, 153, 18, 86, and 154, respectively;
    o. SEQ ID NOs:21, 89, 157, 22, 90, and 158, respectively; or
  a variant thereof comprising up to about 3 (such as about any of 1, 2, or 3) amino acid substitutions in the CDR regions.

Embodiment 45a is a system for inducing activity of an immune cell and/or a target cell, the system comprising an engineered cell comprising a chimeric antigen receptor (CAR), wherein the CAR comprises:
  (a) an extracellular domain comprising an antigen binding fragment that binds specifically to mesothelin, preferably human mesothelin;
  (b) a transmembrane domain; and
  (c) an intracellular signaling domain,
wherein the CAR optionally further comprises a signal peptide at the amino terminus and a hinge region connecting the extracellular domain and the transmembrane domain, and
wherein the antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;

ff. SEQ ID NOs:62, 130, and 198, respectively;
gg. SEQ ID NOs:63, 131, and 199, respectively;
hh. SEQ ID NOs:64, 132, and 200, respectively;
ii. SEQ ID NOs:65, 133, and 201, respectively;
jj. SEQ ID NOs:66, 134, and 202, respectively;
kk. SEQ ID NOs:67, 135, and 203, respectively; or
ll. SEQ ID NOs:68, 136, and 204, respectively; or ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
a. SEQ ID NOs:1, 69, 137, 2, 70, and 138, respectively;
b. SEQ ID NOs:19, 87, 155, 20, 88, and 156, respectively;
c. SEQ ID NOs:23, 91, 159, 24, 92, and 160, respectively;
d. SEQ ID NOs:25, 93, 161, 26, 94, and 162, respectively;
e. SEQ ID NOs:27, 95, 163, 28, 96, and 164, respectively;
f. SEQ ID NOs:29, 97, 165, 30, 98, and 166, respectively;
g. SEQ ID NOs:3, 71, 139, 4, 72, and 140, respectively;
h. SEQ ID NOs:5, 73, 141, 6, 74, and 142, respectively;
i. SEQ ID NOs:7, 75, 143, 8, 76, and 144, respectively;
j. SEQ ID NOs:9, 77, 145, 10, 78, and 146, respectively;
k. SEQ ID NOs:11, 79, 147, 12, 80, and 148, respectively;
l. SEQ ID NOs:13, 81, 149, 14, 82, and 150, respectively;
m. SEQ ID NOs:15, 83, 151, 16, 84, and 152, respectively;
n. SEQ ID NOs:17, 85, 153, 18, 86, and 154, respectively; or
o. SEQ ID NOs:21, 89, 157, 22, 90, and 158, respectively.

Embodiment 46 is the system of embodiment 45 or 45a, wherein the antigen binding fragment comprises:
i. the single domain antibody comprising an amino acid sequence at least 95% identical to an amino acid sequence selected from the group consisting of SEQ ID NOs:221-258 and SEQ ID NOs: 420-428, or a variant thereof, preferably the variant comprises one, two, three or more amino acid substitutions, deletions and/or insertions, or
ii. the single chain variable fragment comprising an amino acid sequence at least 95% identical to an amino acid sequence selected from the group consisting of SEQ ID NOs:205-220 or a variant thereof, preferably the variant comprises one, two, three or more amino acid substitutions, deletions and/or insertions.

Embodiment 46a is the system of embodiment 45 or 45a, wherein the antigen binding fragment comprises:
i. the single domain antibody comprising an amino acid sequence selected from the group consisting of SEQ ID NOs:221-258 and SEQ ID NOs: 420-428, or a variant thereof comprising one, two, three or more amino acid substitutions, deletions and/or insertions; or
ii. the single chain variable fragment comprising an amino acid sequence selected from the group consisting of SEQ ID NOs:205-220, or a variant thereof, preferably the variant comprises one, two, three or more amino acid substitutions, deletions and/or insertions.

Embodiment 46b is the system of embodiment 45 or 45a, wherein the antigen binding fragment comprises:
i. the single domain antibody comprising an amino acid sequence selected from the group consisting of SEQ ID NOs:221-258 and SEQ ID NOs: 420-428; or
ii. the single chain variable fragment comprising an amino acid sequence selected from the group consisting of SEQ ID NOs:205-220.

Embodiment 47 is the system of any one of embodiment 45 to 46b, wherein the CAR further comprises a polypeptide that binds specifically to a follicle-stimulating hormone receptor (FSHR).

Embodiment 48 is the system of embodiment 47, wherein the polypeptide that binds specifically to FSHR comprises an amino acid sequence selected from the group consisting of SEQ ID NOs:319-331.

Embodiment 49 is the system of any one of embodiments 36-47, wherein the CAR comprises a signal peptide having an amino acid sequence that is at least 90% identical to SEQ ID NO:340.

Embodiment 50 is the system of any one of embodiments 36-49, wherein the CAR comprises a hinge region having an amino acid sequence that is at least 90% identical to SEQ ID NO:341.

Embodiment 51 is the system of any one of embodiments 36-50, wherein the CAR comprises a transmembrane domain selected from the group consisting of a CD8α transmembrane domain, a CD28 transmembrane domain, a CD4 transmembrane domain, a CD3ζ transmembrane domain, a CD2 transmembrane domain, a 4-1BB transmembrane domain, an OX40 transmembrane domain, an ICOS transmembrane domain, a CTLA-4 transmembrane domain, a PD-1 transmembrane domain, a LAG-3 transmembrane domain, a 2B4 transmembrane domain, a BTLA transmembrane domain, and a GMCSFR transmembrane domain.

Embodiment 52 is the system of any one of embodiments 36-51, wherein the CAR comprises an intracellular signaling domain selected from the group consisting of a signaling domain of CD3ζ, FcRγ, CD3γ, CD3δ, CD3ε, CD5, CD22, CD79α, CD79β, and CD66δ.

Embodiment 53 is the system of embodiment 52, wherein the CAR comprises a co-stimulatory domain selected from the group consisting of a co-stimulatory domain of one or more of CD28, 4-1BB (CD137), CD27, OX40, CD27, CD40, PD-1, ICOS, lymphocyte function-associated antigen-1 (LFA-1), CD2, CD7, LIGHT, NKG2C, B7-H3, TNFRSF9, TNFRSF4, TNFRSF8, CD40LG, ITGB2, KLRC2, TNFRSF18, TNFRSF14, HAVCR1, LGALS9, CD83, and a ligand that specifically binds with CD83.

Embodiment 54 is the system of embodiment 36, wherein the CAR comprises an amino acid sequence selected from the group consisting of SEQ ID NOs:370-379 and SEQ ID NOs: 448-450.

Embodiment 55 is the system of embodiment 45, wherein the CAR comprises an amino acid sequence selected from the group consisting of SEQ ID NOs:358-367 and SEQ ID NOs: 445-447.

Embodiment 56 is the system of any one of embodiments 36-55, wherein the CAR further comprises a dominant negative form of an inhibitor of a cell-mediated immune response of the immune cell.

Embodiment 57 is the system of embodiment 56, wherein the inhibitor of a cell-mediated immune response of the immune cell is a transforming growth factor β (TGF-β) receptor.

Embodiment 58 is the system of embodiment 57, wherein the dominant negative form of the inhibitor comprises the amino acid sequence of SEQ ID NO:347.

Embodiment 59 is the system of any one of embodiments 56 to 58, wherein the CAR is connected to the dominant negative form of the inhibitor via a 2A peptide coding sequence.

Embodiment 60 is the system of embodiment 59, wherein the CAR comprises an amino acid sequence selected from the group consisting of SEQ ID NO:390-419 and SEQ ID NOs: 460-468.

Embodiment 61 is an isolated antibody or antigen binding fragment, wherein the isolated antibody or antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;
    kk. SEQ ID NOs:67, 135, and 203, respectively; or
    ll. SEQ ID NOs:68, 136, and 204, respectively; or
  ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
    a. SEQ ID NOs:1, 69, 137, 2, 70, and 138, respectively;
    b. SEQ ID NOs:19, 87, 155, 20, 88, and 156, respectively;
    c. SEQ ID NOs:23, 91, 159, 24, 92, and 160, respectively;
    d. SEQ ID NOs:25, 93, 161, 26, 94, and 162, respectively;
    e. SEQ ID NOs:27, 95, 163, 28, 96, and 164, respectively;
    f. SEQ ID NOs:29, 97, 165, 30, 98, and 166, respectively;
    g. SEQ ID NOs:3, 71, 139, 4, 72, and 140, respectively;
    h. SEQ ID NOs:5, 73, 141, 6, 74, and 142, respectively;
    i. SEQ ID NOs:7, 75, 143, 8, 76, and 144, respectively;
    j. SEQ ID NOs:9, 77, 145, 10, 78, and 146, respectively;
    k. SEQ ID NOs:11, 79, 147, 12, 80, and 148, respectively;
    l. SEQ ID NOs:13, 81, 149, 14, 82, and 150, respectively;
    m. SEQ ID NOs:15, 83, 151, 16, 84, and 152, respectively;
    n. SEQ ID NOs:17, 85, 153, 18, 86, and 154, respectively;
    o. SEQ ID NOs:21, 89, 157, 22, 90, and 158, respectively; or
  a variant thereof comprising up to about 3 (such as about any of 1, 2, or 3) amino acid substitutions in the CDR regions, wherein the isolated antibody or antigen binding fragment thereof specifically binds mesothelin, preferably human mesothelin.

Embodiment 61a is an isolated antibody or antigen binding fragment, wherein the isolated antibody or antigen binding fragment comprises:
  i. a single domain antibody (sdAb) comprising a complementarity determining region 1 (CDR1), CDR2 and CDR3 having the polypeptide sequences of:
    a. SEQ ID NOs:34, 102, and 170, respectively;
    b. SEQ ID NOs:54, 122, and 190, respectively;
    c. SEQ ID NOs:55, 123, and 191, respectively;
    d. SEQ ID NOs:61, 129, and 197, respectively;
    e. SEQ ID NOs:31, 99, and 167, respectively;
    f. SEQ ID NOs:32, 100, and 168, respectively;
    g. SEQ ID NOs:33, 101, and 169, respectively;
    h. SEQ ID NOs:35, 103, and 171, respectively;
    i. SEQ ID NOs:36, 104, and 172, respectively;
    j. SEQ ID NOs:37, 105, and 173, respectively;
    k. SEQ ID NOs:38, 106, and 174, respectively;
    l. SEQ ID NOs:39, 107, and 175, respectively;
    m. SEQ ID NOs:40, 108, and 176, respectively;
    n. SEQ ID NOs:41, 109, and 177, respectively;
    o. SEQ ID NOs:42, 110, and 178, respectively;
    p. SEQ ID NOs:43, 111, and 179, respectively;
    q. SEQ ID NOs:44, 112, and 180, respectively;
    r. SEQ ID NOs:45, 113, and 181, respectively;
    s. SEQ ID NOs:46, 114, and 182, respectively;
    t. SEQ ID NOs:47, 115, and 183, respectively;
    u. SEQ ID NOs:48, 116, and 184, respectively;
    v. SEQ ID NOs:49, 117, and 185, respectively;
    w. SEQ ID NOs:50, 118, and 186, respectively;
    x. SEQ ID NOs:51, 119, and 187, respectively;
    y. SEQ ID NOs:52, 120, and 188, respectively;
    z. SEQ ID NOs:53, 121, and 189, respectively;
    aa. SEQ ID NOs:56, 124, and 192, respectively;
    bb. SEQ ID NOs:57, 125, and 193, respectively;
    cc. SEQ ID NOs:58, 126, and 194, respectively;
    dd. SEQ ID NOs:59, 127, and 195, respectively;
    ee. SEQ ID NOs:60, 128, and 196, respectively;
    ff. SEQ ID NOs:62, 130, and 198, respectively;
    gg. SEQ ID NOs:63, 131, and 199, respectively;
    hh. SEQ ID NOs:64, 132, and 200, respectively;
    ii. SEQ ID NOs:65, 133, and 201, respectively;
    jj. SEQ ID NOs:66, 134, and 202, respectively;

kk. SEQ ID NOs:67, 135, and 203, respectively; or
ll. SEQ ID NOs:68, 136, and 204, respectively; or
ii. a single chain variable fragment (scFv) comprising a heavy chain complementarity determining region 1 (HCDR1), HCDR2, HCDR3, a light chain complementarity determining region 1 (LCDR1), LCDR2, and LCDR3, having the polypeptide sequences of:
a. SEQ ID NOs:1, 69, 137, 2, 70, and 138, respectively;
b. SEQ ID NOs:19, 87, 155, 20, 88, and 156, respectively;
c. SEQ ID NOs:23, 91, 159, 24, 92, and 160, respectively;
d. SEQ ID NOs:25, 93, 161, 26, 94, and 162, respectively;
e. SEQ ID NOs:27, 95, 163, 28, 96, and 164, respectively;
f. SEQ ID NOs:29, 97, 165, 30, 98, and 166, respectively;
g. SEQ ID NOs:3, 71, 139, 4, 72, and 140, respectively;
h. SEQ ID NOs:5, 73, 141, 6, 74, and 142, respectively;
i. SEQ ID NOs:7, 75, 143, 8, 76, and 144, respectively;
j. SEQ ID NOs:9, 77, 145, 10, 78, and 146, respectively;
k. SEQ ID NOs:11, 79, 147, 12, 80, and 148, respectively;
l. SEQ ID NOs:13, 81, 149, 14, 82, and 150, respectively;
m. SEQ ID NOs:15, 83, 151, 16, 84, and 152, respectively;
n. SEQ ID NOs:17, 85, 153, 18, 86, and 154, respectively; or
o. SEQ ID NOs:21, 89, 157, 22, 90, and 158, respectively,
wherein the isolated antibody or antigen binding fragment thereof specifically binds mesothelin, preferably human mesothelin.

Embodiment 62 is the isolated antibody or antigen binding fragment of embodiment 61 or 61a, wherein the antibody or antigen binding fragment comprises:
i. the single domain antibody comprising an amino acid sequence at least 95% identical to an amino acid sequence selected from the group consisting of SEQ ID NOs:221-258 and SEQ ID NOs: 420-428, or a variant thereof, preferably the variant comprises one, two, three or more amino acid substitutions, deletions and/or insertions, or
ii. the single chain variable fragment comprising an amino acid sequence at least 95% identical to an amino acid sequence selected from the group consisting of SEQ ID NOs:205-220 or a variant thereof, preferably the variant comprises one, two, three or more amino acid substitutions, deletions and/or insertions.

Embodiment 62a is the isolated polynucleotide of embodiment 61 or 61a, wherein the antigen binding fragment comprises:
i. the single domain antibody comprising an amino acid sequence selected from the group consisting of SEQ ID NOs:221-258 and SEQ ID NOs: 420-428, or a variant thereof comprising one, two, three or more amino acid substitutions, deletions and/or insertions; or
ii. the single chain variable fragment comprising an amino acid sequence selected from the group consisting of SEQ ID NOs:205-220, or a variant thereof, preferably the variant comprises one, two, three or more amino acid substitutions, deletions and/or insertions.

Embodiment 62b is the isolated polynucleotide of embodiment 61 or 61a, wherein the antigen binding fragment comprises:
i. the single domain antibody comprising an amino acid sequence selected from the group consisting of SEQ ID NOs:221-258 and SEQ ID NOs: 420-428; or
ii. the single chain variable fragment comprising an amino acid sequence selected from the group consisting of SEQ ID NOs:205-220.

Embodiment 63 is the isolated antibody or antigen binding fragment of any one of embodiments 61 to 62b, wherein the antibody or antigen binding fragment thereof is chimeric.

Embodiment 64 is the isolated antibody or antigen binding fragment of any one of embodiments 61 to 62b, wherein the antibody or antigen binding fragment thereof is human or humanized.

Embodiment 65 is an isolated nucleic acid encoding the isolated antibody or antigen binding fragment thereof of any one of embodiments 61 to 64.

Embodiment 66 is a vector comprising the isolated nucleic acid of embodiment 65.

Embodiment 67 is a host cell comprising the vector of embodiment 66.

Embodiment 68 is a pharmaceutical composition comprising the isolated antibody or antigen binding fragment thereof of any one of embodiments 61 to 64 and a pharmaceutically acceptable carrier.

Embodiment 69 is a method of treating a cancer in a subject in need thereof, the method comprising administering to the subject the pharmaceutical composition of embodiment 68.

Embodiment 70 is a method of producing the antibody or antigen binding fragment thereof of any one of embodiments 61 to 64, the method comprising culturing a cell comprising a nucleic acid encoding the antibody or antigen binding fragment thereof under conditions to produce the antibody or antigen binding fragment thereof, and recovering the antibody or antigen binding fragment thereof from the cell or culture.

Embodiment 71 is a method of producing a pharmaceutical composition comprising the antibody or antigen binding fragment thereof of any one of embodiments 61 to 64, the method comprising combining the antibody or antigen binding fragment thereof with a pharmaceutically acceptable carrier to obtain the pharmaceutical composition.

Embodiment 72 is an isolated polynucleotide comprising a first nucleotide sequence encoding a fusion protein, wherein the fusion protein comprises, from the N-terminus to the C-terminus, a first polypeptide that binds specifically to a follicle-stimulating hormone receptor (FSHR), and an extracellular domain, a transmembrane domain and an intracellular domain of a CD3 polypeptide selected from the group consisting of a CD3-γ, CD3-δ and CD3-ε chain.

Embodiment 73 is the isolated polynucleotide of Embodiment 72, wherein the extracellular domain of the CD3 polypeptide comprises an amino acid sequence selected from the group consisting of SEQ ID NOs: 433 to 435, respectively; the transmembrane domain comprises an amino acid sequence selected from the group consisting of SEQ ID NOs: 436 to 438, respectively; and the intracellular domain comprises an amino acid sequence selected from the group consisting of SEQ ID NOs: 439 to 441, respectively.

Embodiment 74 is the isolated polynucleotide of Embodiment 72 or 73, wherein the first polypeptide comprises an amino acid sequence selected from the group consisting of SEQ ID NOs:319-331.

Embodiment 74a is the isolated polynucleotide of Embodiment 74, wherein the fusion protein comprises an amino acid sequence selected from the group consisting of SEQ ID NOs: 442-444.

Embodiment 75 is the isolated polynucleotide of any one of Embodiments 72 to 74a, further comprising a second nucleotide sequence encoding a chimeric antigen receptor (CAR), wherein the CAR comprises: (a) an extracellular domain comprising an antigen binding fragment that binds specifically to a tumor antigen; (b) a transmembrane domain; and (c) an intracellular signaling domain.

Embodiment 76 is the isolated polynucleotide of Embodiment 75, wherein the CAR is the CAR of any one of Embodiments 10-11a and 20.

Embodiment 76a is the isolated polynucleotide of Embodiment 76, wherein the CAR comprises a transmembrane domain selected from the group consisting of a CD8α transmembrane domain, a CD28 transmembrane domain, a CD4 transmembrane domain, a CD3ζ transmembrane domain, a CD2 transmembrane domain, a 4-1BB transmembrane domain, an OX40 transmembrane domain, an ICOS transmembrane domain, a CTLA-4 transmembrane domain, a PD-1 transmembrane domain, a LAG-3 transmembrane domain, a 2B4 transmembrane domain, a BTLA transmembrane domain, and a GMCSFR transmembrane domain.

Embodiment 76b is the isolated polynucleotide of Embodiment 76, wherein the CAR comprises an intracellular signaling domain selected from the group consisting of a signaling domain of CD3ζ, FcRγ, FcRβ, CD3γ, CD3δ, CD3ε, CD5, CD22, CD79α, CD79β, and CD66δ.

Embodiment 76c is the isolated polynucleotide of Embodiment 76, wherein the CAR comprises a co-stimulatory domain selected from the group consisting of a co-stimulatory domain of one or more of CD28, 4-1BB (CD137), CD27, OX40, CD27, CD40, PD-1, ICOS, lymphocyte function-associated antigen-1 (LFA-1), CD2, CD7, LIGHT, NKG2C, B7-H3, TNFRSF9, TNFRSF4, TNFRSF8, CD40LG, ITGB2, KLRC2, TNFRSF18, TNFRSF14, HAVCR1, LGALS9, CD83, and a ligand that specifically binds with CD83.

Embodiment 77 is the isolated polynucleotide of Embodiment 76, encoding a protein having an amino acid sequence selected from the group consisting of SEQ ID NOs: 454-456.

Embodiment 78 is the isolated polynucleotide of any one of Embodiments 72 to 77, further comprising a third nucleotide sequence encoding a dominant negative form of an inhibitor of a cell-mediated immune response of the immune cell, preferably a dominant negative form a transforming growth factor β (TGF-β) receptor.

Embodiment 78a is the isolated polynucleotide of Embodiment 78, wherein the dominant negative form of the inhibitor comprises the amino acid sequence of SEQ ID NO:347.

Embodiment 79 is the isolated polynucleotide of Embodiment 78 or 78a, wherein the first nucleotide sequence, the second nucleotide sequence, and/or the third nucleotide sequence are connected to each other via a 2A peptide coding sequence.

Embodiment 79a is the isolated polynucleotide of Embodiment 79, wherein the first nucleotide sequence, the second nucleotide sequence, and the third nucleotide sequence are connected in the order of, from the N-terminus to the C-terminus, the first, second and third nucleotide sequences.

Embodiment 79b is the isolated polynucleotide of Embodiment 79, wherein the first nucleotide sequence, the second nucleotide sequence, and the third nucleotide sequence are connected in the order of, from the N-terminus to the C-terminus, the second, first and third nucleotide sequences.

Embodiment 79c is the isolated polynucleotide of Embodiment 79, wherein the first nucleotide sequence, the second nucleotide sequence, and the third nucleotide sequence are connected in the order of, from the N-terminus to the C-terminus, the third, first and second nucleotide sequences.

Embodiment 79d is the isolated polynucleotide of Embodiment 79, wherein the first nucleotide sequence, the second nucleotide sequence, and the third nucleotide sequence are connected in the order of, from the N-terminus to the C-terminus, the third, second and first nucleotide sequences.

Embodiment 79e is the isolated polynucleotide of Embodiment 79, wherein the first nucleotide sequence, the second nucleotide sequence, and the third nucleotide sequence are connected in the order of, from the N-terminus to the C-terminus, the second, third and first nucleotide sequences.

Embodiment 79f is the isolated polynucleotide of Embodiment 79, wherein the first nucleotide sequence, the second nucleotide sequence, and the third nucleotide sequence are connected in the order of, from the N-terminus to the C-terminus, the first, third and second nucleotide sequences.

Embodiment 80 is the isolated polynucleotide of Embodiment 79, encoding a protein comprising an amino acid sequence selected from the group consisting of SEQ ID NOs:469-471.

Embodiment 81 is a system for inducing activity of an immune cell and/or a target cell, the system comprising an engineered cell comprising a modified TCR complex comprising a fusion protein encoded by the polynucleotide of Embodiments 72-80.

EXAMPLES

The examples provided below are for purposes of illustration only, are not intended to be limiting unless otherwise specified. Thus, the invention should in no way be construed as being limited to the following examples, but rather, should be construed to encompass any and all variations which become evident as a result of the teaching provided herein.

Example 1: Selection of Anti-Mesothelin Antibodies

The mesothelin binding domain to be used in the CAR construct was derived from the panning of phage libraries. The mesothelin binding domain used in the CAR construct can encompass scFv or sdAb.

Animal Immunization

An immunogen comprising recombinant human mesothelin protein having a C-terminal 6-His tag (R&D Systems, Cat #3265-MS; Minneapolis, Minn.) was mixed with adjuvant or PBS followed by injected to mice or camels. Typically, the animals were immunized 2-4 times with 1-week to 2-week intervals. After multiple rounds of immunization, immune reactions against the target antigen were assessed by serum titration through both enzyme-linked immune sorbent assay (ELISA) and flow cytometric assay.

Phage Display Library Construction

Total RNA was extracted from lymphocytes of immunized mouse or immunized camel using TRIZOL® Reagent according to the manufacturer's protocol. cDNA was synthesized based on RNA template with an oligo(dT)$_{20}$ primer using PRIMESCRIPT™ 1$^{st}$ Strand cDNA Synthesis Kit according to the manufacturer's protocol. VHs and VLs were amplified from mouse cDNA for generation of scFv phage library. V$_H$Hs were amplified from camel cDNA for generation of V$_H$H phage library.

Bio-Panning and Isolation of Anti-Mesothelin Antibodies

The constructed scFv phage library and V$_H$H phage library were panned against human mesothelin protein and mesothelin expressing tumor cells, respectively. Output phage particles obtained via panning were used to infect exponentially growing *E. coli* TG1 cells to generate single clones for screening. Individual clones were picked randomly and screened for the binding capacity to mesothelin. Specific binders were selected and sequenced to identify unique anti-mesothelin scFv or sdAb clones.

Example 2: Humanization of Anti-Mesothelin Antibodies 3 anti-mesothelin camelid sdAbs clones: AS65233, AS80444 and AS80533 were selected for humanization. Briefly, CDR grafting approach was applies that 3 CDRs of sdAb were inserted into human framework, followed by several back mutations in framework region to sustain the structure and binding properties of antibodies. 3 humanized sdAb variants (VH4, VH5, VH6) were designed for AS65233, AS80444 and AS80533, respectively (SEQ ID NOs:420-428). To confirm the binding affinity of sdAbs, camelid sdAbs and humanized sdAbs fusion with human IgG1Fc were expressed and purified utilizing eukaryotic expression system. Surface plasmon resonance (SPR) was performed to determine the affinities of purified camelid sdAb and humanized sdAb to human mesothelin. As shown in Table 1, the affinity gap between of camelid sdAbs and humanized sdAbs is less than 3 times.

TABLE 1 affinities of anti-mesothelin sdAbs determined by SPR

| sdAb | Analyte | ka (1/Ms) | kd (1/s) | KD (M) |
|---|---|---|---|---|
| AS65233 | Human mesothelin | 4.26E+05 | 8.34E-03 | 1.96E-08 |
| AS65233VH4 |  | 5.07E+05 | 5.15E-03 | 1.02E-08 |

TABLE 1-continued affinities of anti-mesothelin sdAbs determined by SPR

| sdAb | Analyte | ka (1/Ms) | kd (1/s) | KD (M) |
|---|---|---|---|---|
| AS65233VH5 |  | 3.31E+05 | 8.39E-03 | 2.53E-08 |
| AS65233VH6 |  | 4.50E+05 | 8.60E-03 | 1.91E-08 |
| AS80444 |  | 3.18E+05 | 3.04E-02 | 9.57E-08 |
| AS80444VH4 |  | 3.04E+05 | 4.05E-02 | 1.33E-07 |
| AS80444VH5 |  | 2.53E+05 | 3.12E-02 | 1.23E-07 |
| AS80444VH6 |  | 3.16E+05 | 3.29E-02 | 1.04E-07 |
| AS80533 |  | 1.7E+05 | 5.2E-03 | 3.1E-08 |
| AS80533VH4 |  | 1.5E+05 | 9.3E-03 | 6.3E-08 |
| AS80533VH5 |  | 1.4E+05 | 6.6E-03 | 4.6E-08 |
| AS80533VH6 |  | 1.4E+05 | 7.7E-03 | 5.3E-08 |

Example 3: Preparation of Anti-Mesothelin CAR Constructs

Figure 1B:
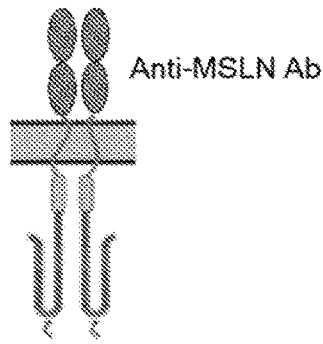
FIG. 1B illustrates the CAR construct anchored in T cell membrane.

The amino acid sequences of the complementarity determining regions (CDRs) of the anti-mesothelin scFv and sdAb fragments are provided in Table 2, and the full length anti-mesothelin scFV and sdAb amino acid sequences are provided in Table 3. Full CAR constructs were generated using a scFv or sdAb fragment of Table 2 with additional sequences to generate full CAR constructs. SS1 scFv (SEQ ID NO:313), which is mouse anti-mesothelin scFv, was used to generate a CAR construct as a reference (SS1 CAR). M5 scFv (SEQ ID NO:314), which is a human anti-mesothelin scFv, was used to generate a CAR construct as a reference (M5 CAR). TC-210, which is a previously described non-conventional CAR construct, comprising a humanized anti-mesothelin sdAb fusing to CD3 epsilon chain (SEQ ID:429), was also used to as a reference. A full length anti-mesothelin CAR construct contains from the N-terminus to the C-terminus: a CD8α signal peptide (SEQ ID NO:340), a mesothelin binding domain scFv or sdAb (SEQ ID NOs:205-258 and SEQ ID NOs:420-428), a CD8α hinge domain (SEQ ID NO:341), a CD8α transmembrane domain (SEQ ID NO:342), a CD137 intracellular domain (SEQ ID NO:343), and a CD3ζ intracellular domain (SEQ ID NO:345). A schematic representation of the anti-mesothelin CAR construct is shown in FIGS. 1A-1B. The CAR fragment was then cloned into lentiviral vectors to create a full length anti-mesothelin CAR construct in a single coding frame, using human EF1 alpha promoter for expression (SEQ ID NO:339). The resulting CAR backbone vector was named "PLLV-hEF1α-mesothelin CAR."

TABLE 2 anti-mesothelin scFV and sdAb CDR amino acid sequences

| Ab | ID | CDR1 Sequence | ID | CDR2 Sequence | ID | CDR3 Sequence |
|---|---|---|---|---|---|---|
| scFv Abs |  |  |  |  |  |  |
| AD58126-VH | 1 | GYTFTSYWMH | 69 | YINPSTGHTDYNQKFKD | 137 | SNWAWFPY |
| AD58126-VL | 2 | KSSQSLLNSGNQKNYLT | 70 | WASTRES | 138 | QNDYSYPLT |
| AD58116-VH | 3 | GYTFTEYTMN | 71 | GIIPNNGDTSYNQKFKG | 139 | RFAY |
| AD58116-VL | 4 | KSSQSLLDSDGKTYLN | 72 | LVSKLDS | 140 | WQGTHFPFT |
| AD58117-VH | 5 | FYTFTAYSMH | 73 | WINTETGEPTYADDFKG | 141 | GLRRFAY |
| AD58117-VL | 6 | RASESVDSYGNSFMN | 74 | LASYLES | 142 | QQNNEDPYT |
| AD58127-VH | 7 | GYTFTDYEIH | 75 | GIDPETGGAAYTQKFKG | 143 | YGNYPLDS |

TABLE 2-continued anti-mesothelin scFV and sdAb CDR amino acid sequences

| Ab | ID | CDR1 Sequence | ID | CDR2 Sequence | ID | CDR3 Sequence |
|---|---|---|---|---|---|---|
| AD58127-VL | 8 | RSSQSLVHSNGNTYLH | 76 | KVSNRFS | 144 | SQSTHVPLT |
| AD58143-VH | 9 | GYTFTDYEMH | 77 | GIDPETGGAAYTQKFKG | 145 | YGNYPLDS |
| AD58143-VL | 10 | RSSQSLVHSNGNTYLH | 78 | KVSNRFS | 146 | SQSTHVPLT |
| AD58159-VH | 11 | GYTITNYWLG | 79 | DIYPGGGYTNYNEKFKG | 147 | GGSSYWYFDV |
| AD58159-VL | 12 | SASQDISNYLN | 80 | YTSSLHS | 148 | QQYSKVPYT |
| AD58115-VH | 13 | GYTFTEYTMN | 81 | GIIPNNGDTSYKQEFKG | 149 | RFAY |
| AD58115-VL | 14 | KSSQSLLDSDGKTYLN | 82 | LVSKLDS | 150 | WQGTHFPFT |
| AD58123-VH | 15 | GFSLSRYSVH | 83 | MIWGGGNTDYNSALKS | 151 | SLGWYFDI |
| AD58123-VL | 16 | KSSQSVLYSSNQKNYLA | 84 | WASTRES | 152 | HQYLSSWT |
| AD58145-VH | 17 | GYTFTSYWMH | 85 | YINPSTGYTDYNQKFKD | 153 | SNWAWFPY |
| AD58145-VL | 18 | KSSQSLLNSGNQKNYLT | 86 | WASTRES | 154 | QNDYSYPLT |
| AS51489-VH | 19 | GFNLYYYSIH | 87 | YISSSSSYTYYADSVKG | 155 | YYPYYGMDY |
| AS51489-VL | 20 | RASQSVSSAVA | 88 | SASSLYS | 156 | QQGFSYYPIT |
| AS51491-VH | 21 | GFNLYSYSMH | 89 | YIYPYSGSTYYADSVKG | 157 | GYGMDY |
| AS51491-VL | 22 | RASQSVSSAVA | 90 | SASSLYS | 158 | QQSYYWLFT |
| AS92110-VH | 23 | GFNIYYSSMH | 91 | YIYPYYSYTYYADSVKG | 159 | GYALDY |
| AS92110-VL | 24 | RASQSVSSAVA | 92 | SASSLYS | 160 | QQASSGYHYLIT |
| AS91156-VH | 25 | GFNIYSSSIH | 93 | SISSYSSYTSYADSVKG | 161 | YYAMDY |
| AS91156-VL | 26 | RASQSVSSAVA | 94 | SASSLYS | 162 | QQGPYYHPIT |
| AS91189-VH | 27 | GFNLSYSSIH | 95 | SIYSYSGSTYYADSVKG | 163 | YWGMDY |
| AS91189-VL | 28 | RASQSVSSAVA | 96 | SASSLYS | 164 | QQYWYYPIT |
| AS51674-VH | 29 | GFNLYSYYMH | 97 | SIYSYSSYTSYADSVKG | 165 | PFGWGYAGMDY |
| AS51674-VL | 30 | RASQSVSSAVA | 98 | SASSLYS | 166 | QQGYAPIT |
| sdAbs | | | | | | |
| AS66073 | 31 | KYSSLYCMA | 99 | VISSGGFTNYADSVKG | 167 | GLSYCHSSTATATY |
| AS66439 | 32 | GFTSSDCDMD | 100 | SLLSTDGSTSYADSVRG | 168 | AEWGGMDY |
| AS65955 | 33 | GDRVSTGCMG | 101 | QIHNYNIAKYADSVKG | 169 | PVDCSWSMFLQDPLALSPP |
| AS65233 | 34 | EFTYSMG | 102 | HIYTRGGTTVYADSVKG | 170 | RTIFEGSWSSPSSFDF |
| AS65926 | 35 | GNLYNNMCMG | 103 | SIYIGGGYTNYADSVKG | 171 | VSIALTREFCAPIVSRYNY |
| AS66159 | 36 | GNVYNNMCMG | 104 | SIYVGGGYTNYADSVRG | 172 | ITVALTRAFCAPIPSRYTN |
| AS66416 | 37 | GNLYNNMCMG | 105 | SIYIGGGYTNYSESVRG | 173 | IPIALTRAFCAPIVSRYTY |
| AS65850 | 38 | GFSYSNICMG | 106 | AIYSNGSTIYADSVKG | 174 | GRCGGPNY |
| AS65183 | 39 | NGYYNRRYCMA | 107 | TMTTTSGRTYYADAVKG | 175 | HLPSSWVTSTDYCDNLQAGFYNS |
| AS65062 | 40 | GVSVVNFAMR | 108 | AMYRSGSTSYADSVRG | 176 | TSPMGDTY |
| AS65065 | 41 | GYSYCRSTMR | 109 | AIYSDGTTSYTDSVKG | 177 | DLVGCNVAGGSPY |
| AS65556 | 42 | GYNASICRMS | 110 | SSYRDGSQSYADSVKG | 178 | ACPWRAY |
| AS65069 | 43 | GDTGYQPTMR | 111 | AIYSDQTTSYADSVKG | 179 | TTRRGSEY |
| AS65691 | 44 | GYTDYRLVLR | 112 | AIYSDGVTSYSDSVKG | 180 | TGSGGVAY |

TABLE 2-continued anti-mesothelin scFV and sdAb CDR amino acid sequences

| Ab | ID | CDR1 Sequence | ID | CDR2 Sequence | ID | CDR3 Sequence |
|---|---|---|---|---|---|---|
| AS65064 | 45 | GDTVQTNCMA | 113 | SILSLYSSGGKTVYADSVKG | 181 | VRVTVTWAEKLRRCTGFSGMDY |
| AS65081 | 46 | GVPASSYCMG | 114 | GIVSDTTTTYADSVKG | 182 | SHFLLCARKPRWDDLIKYEY |
| AS65115 | 47 | GYIYGCMG | 115 | TIYRDGTAYYANSVEG | 183 | RTTGCNWDISGVY |
| AS65271 | 48 | GKTYGRCMA | 116 | ATYISGGRPYVADSVKG | 184 | GSAGRGPCDRFDQNQYTF |
| AS65166 | 49 | EDLSIYGYNCMG | 117 | AIYTGRGTTYYADSVKG | 185 | KYCAVVADFGNSRLVRY |
| AS65450 | 50 | GDMNGYKCMG | 118 | GIYTGRGTTYYADSVKD | 186 | KYCAVVAEFGGPRLVRY |
| AS65454 | 51 | GDMNGYKCMG | 119 | GIYTGRNTTYYADSVKD | 187 | YCAVVAEFRGPRLDRY |
| AS65131 | 52 | EYVTHLG | 120 | IESFRIGYTYYADSVKG | 188 | RQDRSGASMVNRDSYNY |
| AS65182 | 53 | GYTYSYGYMG | 121 | KIYNGDGSTYYADSVKG | 189 | NRLPNSDVDLVLPRFGRFGY |
| AS60685 | 54 | GNVYNNMCMG | 122 | SMYVGGGYTYYDDSVKG | 190 | ISIALTREFCAPIVSRYNY |
| AS60702 | 55 | GNVYNNMCMG | 123 | SIYVGGGYTNYADSVRG | 191 | ITVALTRAFCAPIPSRYTN |
| AS60705 | 56 | GYAYSGSCMMA | 124 | VSVRRTGSAFYADSVKA | 192 | DFTCRTWTLNKNYNH |
| AS60660 | 57 | GDTGYQPTMR | 125 | AIYSDQTTSYADSVKG | 193 | TTRRGSEY |
| AS60662 | 58 | GYRNCRSTMR | 126 | SIYTDGTTSYTDSVKG | 194 | DLVGCNVAGGSPY |
| AS60664 | 59 | GKTYGRCMA | 127 | ATYISGGRPYVADSVKG | 195 | GSAGRGPCDRFDQNQYTF |
| AS60668 | 60 | GDMNGYKCMG | 128 | GIYTGRNTTYYADSVKD | 196 | KYCAVVAEFGGPRLVRY |
| AS60676 | 61 | GYTVSSGCMG | 129 | QIGRDATTTYADSVKG | 197 | YWGVYCLSPGRY |
| AS60678 | 62 | GYTSSRGCMS | 130 | YINMRVLTTIYAASVKD | 198 | GYNGQWCEHASDVTA |
| AS60679 | 63 | GVTYCRLTMR | 131 | AIYSDGSTAYADSVKG | 199 | NCASGLTA |
| AS81326 | 64 | ESRDCMA | 132 | SIYAPDGSTTYADTVKG | 200 | GGLSRNTCGYLRGGYFAY |
| AS81187 | 65 | GYTYSSYSSNCLG | 133 | RIYPNSGSTYYADSVKG | 201 | AVGVGDNWCASGAAYFGY |
| AS80533 | 66 | GLSFSTYTVA | 134 | AIPYTSQHMVYTDSVKG | 202 | DRRPGTSMLAINGYNR |
| AS80444 | 67 | GFTFSRNTMG | 135 | AIPYTSTGIVYSDSVGG | 203 | DRRPGTTMLAVNGYNH |
| AS81487 | 68 | KLTAWRSCVG | 136 | AIYSGTGSTYYADSVKG | 204 | TSIRSSCGLVRDEYAY |

TABLE 3 anti-mesothelin scFV and sdAb amino acid sequences

| Ab | Amino Acid Sequence | ID |
|---|---|---|
| AD58126 scFv | QVQLKQSGAELAKPGASVEMSCKASGYTFTSYWMHWVKQRPGQGLEWIGYINPSTGHT DYNQKFKDKATLTADKSSSTAYMQLSSLTSEDSAVYYCARSNWAW FPYWGQGTLVTVSSGGGGSGGGGSGGGGSDIVMTQSPSSLTVTAGEKVTMSCKSSQSLL NSGNQKNYLTWYQQKPGKPPKLLIYWASTRESGVPDRFTGSGSGTDFTLTISSVQAEDLA VYYCQNDYSYPLTFGSGTRLEIK | 205 |
| AD58126 VH3VL1 scFv | QVQLVQSGAEVKKPGASVKVSCKASGYTFTSYWMHWVKQAPGQGLEWIGYINPSTGH TDYNQKFKDRATLTADTSTSTVYMELSSLRSEDTAVYYCARSNWAWFPYWGQGTLVT VSSGGGGSGGGGSGGGGSDIVMTQSPDSLAVSLGERATINCKSSQSLLNSGNQKNYLTW YQQKPGQPPKLLIYWASTRESGVPDRFSGSGSGTDFTLTISSLQAEDVAVYYCQNDYSYP LTFGGGTKLEIK | 206 |
| AD58116 scFv | QVQLKESGPELVKPGASVKISCKTSGYTFTEYTMNWVRQSHGKSLEWIGGIIPN NGDTSYNQKFKGKATLTVDKSSSTAYMELRSLTSEDSAVYYCAGRFAYWGQG TLVTVSSGGGGSGGGGSGGGGSDIVMTQAPLTLSVTIGQPASISCKSSQSLLDSD GKTYLNWFLQRPGQSPKRLIYLVSKLDSGVPDRFTGSGSGTDFTLKISRVEAEDLGVYYC WQGTHFPFTFGSGTKLEIK | 207 |

TABLE 3-continued anti-mesothelin scFV and sdAb amino acid sequences

| Ab | Amino Acid Sequence | ID |
|---|---|---|
| AD58117 scFv | QVQLQQSGPELKKPGETVKISCKASFYTFTAYSMHWVKQAPGKGLKWMGWIN TETGEPTYADDFKGRFAFSLETSATTAYLQINNLKNEDTATFFCARGLRRFAYW GQGTLVTVSSGGGGSGGGGSGGGGSDIVMTQSPTSLAVSLGQRATISCRASESV DSYGNSFMNWYQQKPGQPPKLLIYLASYLESGVPARFSGSGSRTDFTLTIDPVEADDAAT YYCQQNNEDPYTFGGGTRLEIK | 208 |
| AD58127 scFv | QVQLQQSGAELVRPGASVTLSCKASGYTFTDYEIHWVKQTPVHGLEWIGGIDPETGGAA YTQKFKGKATLTADKSSSTAYMELRSLTSEDSAVYYCTTYGNYPLDSWGQGTTLTVSSG GGGGSGGGGSGGGGSGIVMTQTPLSLPVSLGDQASISCRSSQSLVHSNGNTYLHWYLQKP GQSPKLLIYKVSNRFSGVPDRFSGSGSGTDFTLKISRVEAEDLGVYFCSQSTHVPLTFGAG TRLEIK | 209 |
| AD58143 scFv | QVQLKQSGAELVRPGASVTLSCKASGYTFTDYEMHWVKQTPVHGLEWIGGIDPETGGA AYTQKFKGKATPTADKSSSTAYMELRSLTSEDSAVYYCTTYGNYPLDSWGQGTTVTVSS GGGGSGGGGSGGGGSDIQMTQTPLSLPVSLGDQASISCRSSQSLVHSNGNTYLHWYLQK PGQSPKLLIYKVSNRFSGVPDRFSGSGSGTDFTLKISGVEAEDLGVYFCSQSTHVPLTFGA GTKLELK | 210 |
| AD58159 scFv | QVQLKQSGAELVRPGTSVKISCKASGYTITNYWLGWVKQRPGHGLEWIGDIYPGGGYTN YNEKFKGKATLTADTSSITAYMQLSSLTSEDSAVYFCARGGSSYWYFDVWGAGTSVTVS SGGGGSGGGGSGGGGSDIQMTQTTSLSASLGDRVTISCSASQDISNYLNWYQQKPDGT VKLLIYYTSSLHSGVPSRFSGSGSGTDYSLTISNLEPEDIATYYCQQYSKVPYTFGGGTKL ELK | 211 |
| AD58115 scFv | QVQLKQSGPELVKPGASVKISCKTSGYTFTEYTMNWVKQSHGKSLEWIGGIIPN NGDTSYKQEFKGKATLTVDKSSSTAYMELRSLTSDDSAVYYCAGRFAYWGQG TLVTVSSGGGGSGGGGSGGGGSDIVMTQTPLTLSVTIGQPASISCKSSQSLLDSD GKTYLNWFLQRPGQSPKRLIYLVSKLDSGVPDRFTGSGSGTDFTLKISRVEAEDLGVYYC WQGTHFPFTFGSGTKLEIK | 212 |
| AD58123 scFv | EVQLQQSGPGLVAPSQSLSITCTVSGFSLSRYSVHWVRQPPGKGLEWLGMIWG GGNTDYNSALKSRLSISKDNSKSQVFLKMNSLQTDDTAMYYCARSLGWYFDI WGAGTTVTVSSGGGGSGGGGSGGGGSDIVMTQSPSSLAVSAGEKVTMSCKSS QSVLYSSNQKNYLAWYQQKPGQSPKLLIYWASTRESGVPDRFTGSGSGTDFTLTISSVQA EDLAVYYCHQYLSSWTFGGGTKLEIK | 213 |
| AD58145 scFv | EVQLQQSGAELAKPGASVKMSCKASGYTFTSYWMHWVKQRPGQGLEWIGYI NPSTGYTDYNQKFKDKATLTADKSSSTAYMQLSSLTSEDSAVYYCARSNWAW FPYWGQGTLVTVSSGGGGSGGGGSGGGGSDIQMTQSPSSLTVTAGEKVTMSC KSSQSLLNSGNQKNYLTWYQQKPGQPPKLLIYWASTRESGVPDRFTGSGSGTD FTLTISSVQAEDLAVYYCQNDYSYPLTFGAGTKLELK | 214 |
| AS51489 scFv | EVQLVESGGGLVQPGGSLRLSCAASGFNLYYYSIHWVRQAPGKGLEWVAYIS SSSSYTYYADSVKGRFTISADTSKNTAYLQMNSLRAEDTAVYYCARYYPYYG MDYWGQGTLVTVSSGGGGSGGGGSGGGGSDIQMTQSPSSLSASVGDRVTITC QPEDFATYYCQQGFSYYPITFGQGTKVEIK RASQSVSSAVAWYQQKPGKAPKLLIYSASSLYSGVPSRFSGSRSGTDFTLTISSL QPEDFATYYCQQGFSYYPITFGQGTKVEIK | 215 |
| AS51491 scFv | EVQLVESGGGLVQPGGSLRLSCAASGFNLYSYSMHWVRQAPGKGLEWVAY IYPYSGSTYYADSVKGRFTISADTSKNTAYLQMNSLRAEDTAVYYCARGYG MDYWGQGTLVTVSSGGGGSGGGGSGGGGSDIQMTQSPSSLSASVGDRVTIT CRASQSVSSAVAWYQQKPGKAPKLLIYSASSLYSGVPSRFSGSRSGTDFTLTIS SLQPEDFATYYCQQSYWLFTFGQGTKVEIK | 216 |
| AS92110 scFv | EVQLVESGGGLVQPGGSLRLSCAASGFNIYYSSMHWVRQAPGKGLEWVAYIYPYYSYT YYADSVKGRFTISADTSKNTAYLQMNSLRAEDTAVYYCARGYALDYWGQGTLVTVSSG GGGSGGGGSGGGGSDIQMTQSPSSLSASVGDRVTITCRASQSVSSAVAWYQQKPGKAPK LLIYSASSLYSGVPSRFSGSRSGTDFTLTISSLQPEDFATYYCQQASSGYHY- LITFGQGTKV EIK | 217 |
| AS91156 scFv | EVQLVESGGGLVQPGGSLRLSCAASGFNIYSSSIHWVRQAPGKGLEWVASISSYSSYTSY ADSVKGRFTISADTSKNTAYLQMNSLRAEDTAVYYCARYYAMDYWGQGTLVTVSSGG GGSGGGGSGGGGSDIQMTQSPSSLSASVGDRVTITCRASQSVSSAVAWYQQKPGKAPKL LIYSASSLYSGVPSRFSGSRSGTDFTLTISSLQPEDFATYYCQQGPYYH- PITFGQGTKVEIK | 218 |
| AS91189 scFv | EVQLVESGGGLVQPGGSLRLSCAASGFNLSYSSIHWVRQAPGKGLEWVASIYSYSGSTY YADSVKGRFTISADTSKNTAYLQMNSLRAEDTAVYYCARYWGMDYWGQGTLVTVSS GGGGSGGGGSGGGGSDIQMTQSPSSLSASVGDRVTITCRASQSVSSAVAWYQQKPGKAPK LLIYSASSLYSGVPSRFSGSRSGTDFTLTISSLQPEDFATYYCQQYYWYYP- ITFGQGTKVEI K | 219 |

TABLE 3-continued anti-mesothelin scFV and sdAb amino acid sequences

| Ab | Amino Acid Sequence | ID |
|---|---|---|
| AS51674 scFv | EVQLVESGGGLVQPGGSLRLSCAASGFNLYSYYMHWVRQAPGKGLEWVASIYSYSSYT SYADSVKGRFTISADTSKNTAYLQMNSLRAEDTAVYYCARPFGWGYAGMDYWGQGTL VTVSSGGGGSGGGGSGGGGSDIQMTQSPSSLSASVGDRVTITCRASQSVSSAVAWYQQK PGKAPKLLIYSASSLYSGVPSRFSGSRSGTDFTLTISSLQPEDFATYYCQQG-YAPITFGQGT KVEIK | 220 |
| AS66073 sdAb | QVQLVESGGDSVQAGGSLTLACTGRKYSSLYCMAWFRQAPGKAREGVAVISSGGFTNY ADSVKGRFTISRDNSKNTLYLAMNGLKPEDTAMYYCAAGLSYCHSSTATATYRGQGTQ VTVSS | 221 |
| AS66439 sdAb | QMQLVESGGGSVQAGGSLRLSCTAPGFTSSDCDMDWYRQAAGNQREWVSSLLSTDGST SYADSVRGRFTISKDPAKDTVYLQMNSLKPEDTAMYFCRCVVAEWGGMDYWGKGTLV TVSS | 222 |
| AS65955 sdAb | QVHLVESGGGSVQAGGSLRLSCAASGDRVSTGCMGWFRQPGEEREGLAQIHNYNIAK YADSVKGRFTISKDNAKNILYLQMNSLKPEDTGLYICTAPVDCSWSMFLQDPLALSPPRG QGTQVTVSS | 223 |
| AS65233 sdAb | QVHLVESGGGSVQAGGSLRLSCAASEFTYSMGWFRQAPGKEREGVAHIYTRGGTTVYA DSVKGRFVLSRYNAKSIMYLQMNSVKLEDTAMYYCAARTIFEGSWSSPSSFDFWGQGT QVTVSS | 224 |
| AS65926 sdAb | QVQLVESGGGSVQAGGSLRLSCAASGNLYNNMCMGWFRQAPGKEREGVASIYIGGGYT NYADSVKGRFTISPISRDNAKSTLYLQMNSLKPEDTAMYYCAAVSIALTREFCAPIVSRY NYWGQGTQVTVSS | 225 |
| AS66159 sdAb | QVRLVESGGGSVQAGGSLRLSCAASGNVYNNMCMGWFRQAPGKEREGVASIYVGGGY TNYADSVRGRFTISQDNAKNTLYLQMNSLKPEDTAMYYCAAITVALTRAFCAPIPSRYT NWGQGTQVTVSS | 226 |
| AS66416 sdAb | QVQLAESGGGSVQAGGSLRLSCAASGNLYNNMCMGWFRQAPGKEREGVGSIYIGGGYT NYSESVRGRFTISLDNAKKTLNLQMNSLKPEDTAMYYCAAIPIALTRAFCAPIVSRYTYW GQGTQVTVSS | 227 |
| AS65850 sdAb | EVQLMESGGGSVQAGGSLRLSCAASGFSYSNICMGWFRQAPGKEREGVAAIYSNGSTIY ADSVKGRFTVSKEFAKNTQYLQMNSLKPEDTAMYYCAAGRCGGPNYWGQGTQVTVSS | 228 |
| AS65183 sdAb | EVQLAESGGGSAQAGGSLRLSCASNGYYNRRYCMAWFRQAPGKEREGVATMTTTSGR TYYADAVKGRFTVSQDNAKSTLYLQMSSLKPEDTAMYYCAAHLPSSWVTSTDYCDNLQ AGFYNSWGQGTQVTVSS | 229 |
| AS65062 sdAb | QVHLVESGGGSVQAGGSLRLSCAASGVSVVNFAMRWYRQAPGNEREFVSAMYRSGSTS YADSVRGRFTISRDSALNTVFLQMSGLKPEDTATYYCQATSPMGDTYWGQGTQVTVSS | 230 |
| AS65065 sdAb | EVQLAESGGGSVQAGGSLRLSCAASGYSYCRSTMRWYRQAPGNVREFVSAIYSDGTTSY TDSVKGRFTISQDNAKNTVYLQMNSLQPEDTAMYYCRIDLVGCNVAGGSPYWGQGTQV TVSS | 231 |
| AS65556 sdAb | QVHLVESGGGSVQVGGSLRLSCAASGYNASICRMSWYRQAPGTEREFVSSSYRDGSQSY ADSVKGRFTTSRDSAKNTVFLQMNSLKPSDTAMYYCNAACPWRAYWGQGTQVTVSS | 232 |
| AS65069 sdAb | QVHLVESGGGSVQAGGSLRLSCVASGDTGYQPTMRWYRQAPGKEREFVSAIYSDQTTS YADSVKGRFTISQDNARKTVYLQMASLKPEDTAMYYCKLTTRRGSEYWGQGTQVTVSS | 233 |
| AS65691 sdAb | QMQLVESGGGSVQAGGSLRLSCTVSGYTDYRLVLRWYRQALGKEREFISAIYSDGVTSY SDSVKGRFTISRDNAKNTAYLQMNSLKSEDTAMYYCKATGSGGVAYWGQGTQVTVSS | 234 |
| AS65064 sdAb | QVQLVESGGGSVQAGGSLKLSCAVSGDTVQTNCMAWFRQAPGKEREAVASILSLYSSG GKTVYADSVKGRFTISPDNAQNTVSLQMNNLKPEDTAMYYCATVRVTVTWAEKLRRCT GFSGMDYWGKGTLVTVSS | 235 |
| AS65081 sdAb | QVHLMESGGGSVQAGGSLRLSCAASGVPASSYCMGWFRQAPGKEREGVAGIVSDTTTT YADSVKGRFTISKDNAKNTLYLQMNSLKPEDTATYYCAASHFLLCARKPRWDDLIKYEY WGQGTQVTVSS | 236 |
| AS65115 sdAb | QVQLVESGGGSVQAGGSLRLSCAASGYIYGCMGWFRRAPGKAREEVATIYRDGTAYYA NSVEGRFTASRNNAENTLSLEMNSLNAEDTAMYYCAARTTGCNWDISGVYWGQGTQV TVSS | 237 |
| AS65271 sdAb | QMQLVESGGGSVQAGGSLTLSCAASGKTYGRCMAWFRQAPGKERELVAATYISGGRPY VADSVKGRFTISRDNAKSTMSLQMNSLRPDDSAMYYCAAGSAGRGPCDRFDQNQYTFW GQGTQVTVSS | 238 |

TABLE 3-continued anti-mesothelin scFV and sdAb amino acid sequences

| Ab | Amino Acid Sequence | ID |
|---|---|---|
| AS65166 sdAb | QVQLVESGGGSVQAGGSLRLSCTASEDLSIYGYNCMGWFRQAPGKEREAVAAIYTGRG TTYYADSVKGRFTISQDNAKNTVYLQMNSLKPEDTAMYYCASKYCAVVADFGNSRLVR YWGQGTQVTVSS | 239 |
| AS65450 sdAb | QVRLVESGGGSVQAGGSLRLSCAASGDMNGYKCMGWFRQAPGKEREAVAGIYTGRGT TYYADSVKDRFTISQDNAKNTVYLQMNSLKPEDTAMYYCAAKYCAVVAEFGGPRLVR YWGQGTQVTVSS | 240 |
| AS65454 sdAb | QVRLVESGGGSVQAGGSLRLSCAASGDMNGYKCMGWFRQAPGKEREAVAGIYTGRNT TYYADSVKDLFTISQDNAQNTVFLQMNSLKPEDTAMYYCASYCAVVAEFRGPRLDRYW GYGTQVTVTS | 241 |
| AS65131 sdAb | EVQLAESGGGSVQAGGSLTLSCTASEYVTHLGWFRQAPGKEREGVAIESFRIGYTYYAD SVKGRFTISHDNAKNTLYLQMNSLKPEDTAIYYCAARQDRSGASMVNRDSYNYWGKGT QVTVSS | 242 |
| AS65182 sdAb | QVKLVESGGGSVQAGGSLRLSCAASGYTYSYGYMGWFRQAPGKEREGVAKIYNGDGST YYADSVKGRFTISQDRRNNTLYLQMNSLAPEDTGMYYCATNRLPNSDVDLVLPRFGRFG YWGQGTQVTVSS | 243 |
| AS60685 sdAb | QVLVESGGGSVQAGGSLRLSCAASGNVYNNMCMGWFRQAPGKEREGVASMYVGGG YTYYDDSVKGRFTISRDNAKNTLYLQMNSLKPEDTAMYYCAAISIALTREFCAPIVSRYN YWGQGTQVTVSS | 244 |
| AS60702 sdAb | QVKLVESGGGSVQAGGSLRLSCAASGNVYNNMCMGWFRQAPGKEREGVASIYVGGGY TNYADSVRGRFTISQDNAKNTLYLQMNSLKPEDTAMYYCAAITVALTRAFCAPIPSRYT NWGQGTQVTVSS | 245 |
| AS60705 sdAb | QVQLVESGGGSVQSGGSLRLSCAASGYAYSGSCMMAWFRQAPGKEREGVAVSVRRTGS AFYADSVKARFTISRDNAKNTLYLQMNNLKVEDTAMYYCAADFTCRTWTLNKNYNHW GQGTQVTVSS | 246 |
| AS60660 sdAb | QVHLMESGGGSVQAGGSLRLSCVASGDTGYQPTMRWYRQAPGKEREFVSAIYSDQTTS YADSVKGRFTISQDNARKTVYLQMASLKPEDTAMYYCKLTTRRGSEYWGQGTQVTVSS | 247 |
| AS60662 sdAb | QVHLVESGGGSVQAGGSLRLSCVASGYRNCRSTMRWYRQGPGQVRDWVSSIYTDGTTS YTDSVKGRFTIAQDKGKNTVYLQMNSLQPEDTAMYYCRIDLVGCNVAGGSPYWGHGT QVTVSS | 248 |
| AS60664 sdAb | QVHLVESGGGSVQAGGSLTLSCAASGKTYGRCMAWFRQAPGKERELVAATYISGGRPY VADSVKGRFTISRDNAKSTMSLQMNSLRPDDSAMYYCAAGSAGRGPCDRFDQNQYTFW GQGTQVTVSS | 249 |
| AS60668 sdAb | QVHLVESGGGSVQAGGSLRLSCAASGDMNGYKCMGWFRQAPGKEREAVAGIYTGRNT TYYADSVKDRFTISQDNAKNTVFLQMNSLKPEDTAMYYCASKYCAVVAEFGGPRLVRY WGQGTQVTVSS | 250 |
| AS60676 sdAb | QVQLVESGGGSVQAGGSLRLSCAASGYTVSSGCMGWFRQAPGKERERVAQIGRDATTT YADSVKGRFTIARDDAENTLYLQMNSLKPEDTAMYSCTAYWGVYCLSPGRYWGQGTQ VTVSS | 251 |
| AS60678 sdAb | QVHLVESGGGSVQAGGSLRLSCAVSGYTSSRGCMSWFRQAPGKERERVAYINMRVLTTI YAASVKDRFAISRDNAKNTVDLQMNNLKPEDTAMYYCAAGYNGQWCEHASDVTAWG QGTQVTVSS | 252 |
| AS60679 sdAb | QVHLMESGGGSVQAGGSLRLSCARSGVTYCRLTMRWYRQAPGSEREFVSAIYSDGSTA YADSVKGRFTMSQDDAKNTVYLQMNSVKPEDTAMYYCKLNCASGLTAWGQGTQVTV SS | 253 |
| AS81326 sdAb | EVQLVESGGGSVQAGGSLTLSCAASESRDCMAWFRQAPGKAREGVASIYAPDGSTTYA DTVKGRFTISQDNAKNTLYLQMNSLQPEDAAMYHCAIGGLSRNTCGYLRGGYFAYFGR GTQVTVSS | 254 |
| AS81887 sdAb | QVRLVESGGGSVQAGGSLRLSCAASGYTYSSYSSNCLGWFRQAPGKEREAVARIYPNSG STYYADSVKGRFTISQDNAKNTVYLQMNSLKPEDTAMYYCAVAVGVGDNWCASGAAY FGYWGQGTQVTVSS | 255 |
| AS80533 sdAb | QVHLVESGGGSVQTGGSLRLSCTASGLSFSTYTVAWFRQAPGKEREGVAAIPYTSQHMV YTDSVKGRFTISRDNTKNMVYLQMNSLKPEDTAMYYCATDRRPGTSMLAINGYNRWG QGTQVTVSS | 256 |
| AS80444 sdAb | EVQLAESGGGSVQAGGSLRLSCAASGFTFSRNTMGWFRQAPGKEREGVAAIPYTSTGIV YSDSVGGRFTISRDNTKNMVYLQMNNLEPEDTAMYYCATDRRPGTTMLAVNGYNHWG QGTQVTVSS | 257 |

TABLE 3-continued anti-mesothelin scFV and sdAb amino acid sequences

| Ab | Amino Acid Sequence | ID |
|---|---|---|
| AS81487 sdAb | QVRLVESGGGSVQAGGSLRVSCLVSKLTAWRSCVGWFRQAPGKEREGVAAIYSGTGST YYADSVKGRFTIAQDYAKNMVYLQMNSLKPEDTAMYYCAGTSIRSSCGLVRDEYAYW GQGTQVTVSS | 258 |

Example 4: Generation of Anti-Mesothelin CAR-T

Preparation of Lentivirus

The lentivirus packaging plasmid mixture including pCMV-ΔR-8.47 and pMD2.G (Addgene, Cat #12259; Cambridge, Mass.) was pre-mixed with the vectors PLLV-hEF1α-mesothelin at a pre-optimized ratio with polyethylenimine, followed by addition to the HEK293 cells. The supernatants were collected after overnight incubation. The virus-containing supernatants were filtered through a 0.45 μm PES filter, followed by ultra-centrifugation for lentivirus concentration. The virus pellets were rinsed with pre-chilled DPBS. The virus was aliquoted properly, then stored at −80° C. immediately. The virus titer was determined by measurement of transduction efficiency to supT1 cell line via flow cytometric assay.

Collection and Transduction of T Lymphocyte

Leukocytes were collected from healthy donors by apheresis. Peripheral blood mononuclear cells (PBMCs) were isolated using FICOLL-PAQUE™ PLUS Media according to manufacturer's protocol. Human T cells were purified from PMBCs using Pan T cell isolation kit (Miltenyi, Cat #130-096-535; Bergisch Gladbach, Germany), following manufacturer's protocol. The purified T cells were subsequently pre-activated for 48 hours with human T cell activation/expansion kit (Miltenyi, Cat #130-091-441) according to manufacturer's protocol in which anti-CD3/CD28 MACSiBead particles were added at a bead-to-cell ratio of 1:2. The pre-activated T cells were transduced with lentivirus stock in the presence of 7 μg/ml polybrene. The transduced cells were then transferred to the cell culture incubator for transgene expression under suitable conditions.

Example 5: Evaluation of In Vitro Activities of Anti-Mesothelin CAR-Ts

In Vitro Cytotoxicity Assay

OVCAR-8 cells, which is a human ovarian cancer cell line expresses both mesothelin and FSHR, were used as the target cell in the following studies to evaluate the activities of CAR-Ts. On day 5 or day 9 after transduction, transduced T cells were harvested and co-incubated with an effector cell (CAR-T) to target cell (OVCAR-8) ratio of 7.5:1 for 20 hours. SS1 CAR-T, M5 CAR-T and TC-210 were used as controls. The controls SS1 CAR-T and M5 CAR-T were used in all assays to compare assay variation and/or act as a control. Un-transduced T cells (UnT) were used as a negative control.

Figure 7:
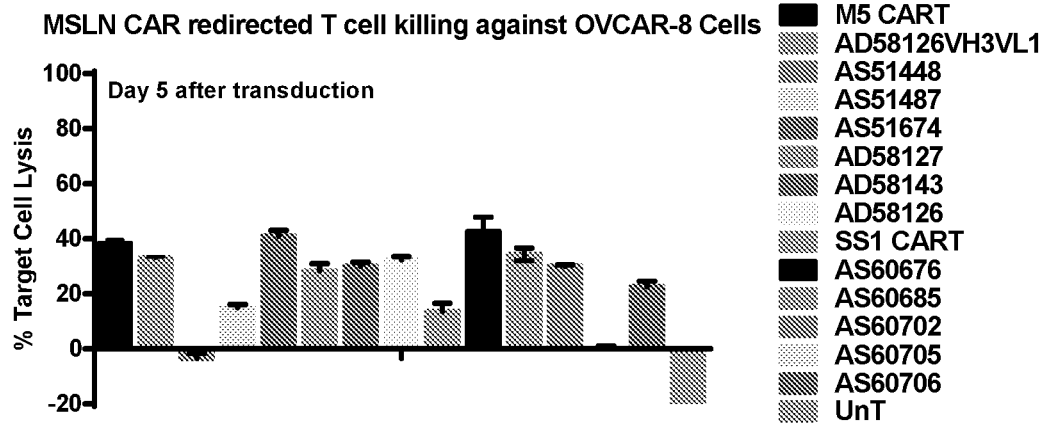
FIGS. 7-8 are graphs demonstrating anti-mesothelin CAR-T according to embodiments of the invention induced killing against OVCAR-8 cells. In each figure, the results for the CARs are depicted in the order as in the legend shown on the right.
Figure 8:
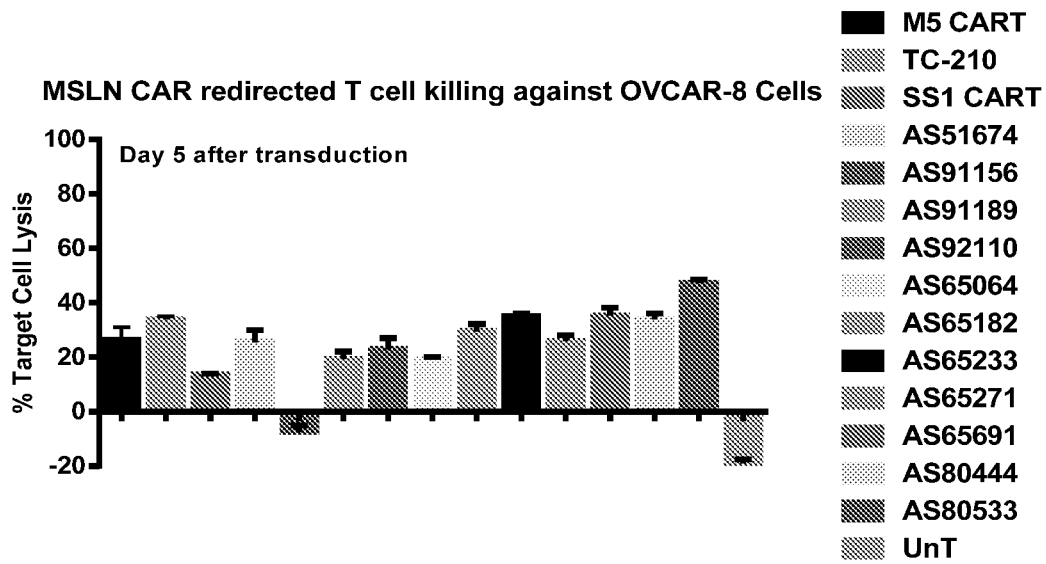

The cytotoxicity was determined by a lactate dehydrogenase (LDH) assay. The results showed that M5 CAR-T, AS51674 CAR-T, AS60676 CAR-T, TC-210, AS65233 CAR-T, AS65691 CAR-T, AS80444 CAR-T and AS80533 CAR-T exhibited strong anti-tumor activities in vitro against OVCAR-8 cells, while SS1 CAR-T showed inferior in vitro activities, UnT had no killing effect (FIG. 7 and FIG. 8).

IFNγ Release Assay

Figure 9:
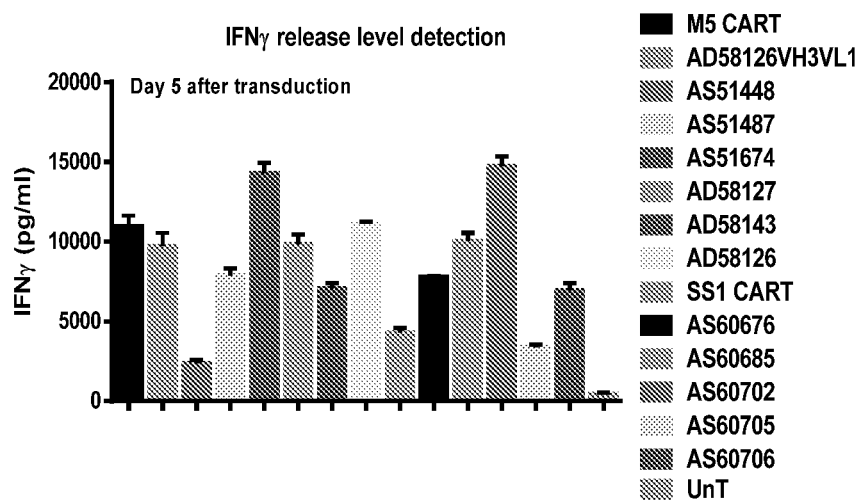
FIGS. 9-10 are graphs showing the level of IFNγ in the supernatant of T cells transduced with various CAR constructs according to embodiments of the application. In each figure, the results for the CARS are depicted in the order as in the legend shown on the right.
Figure 10:
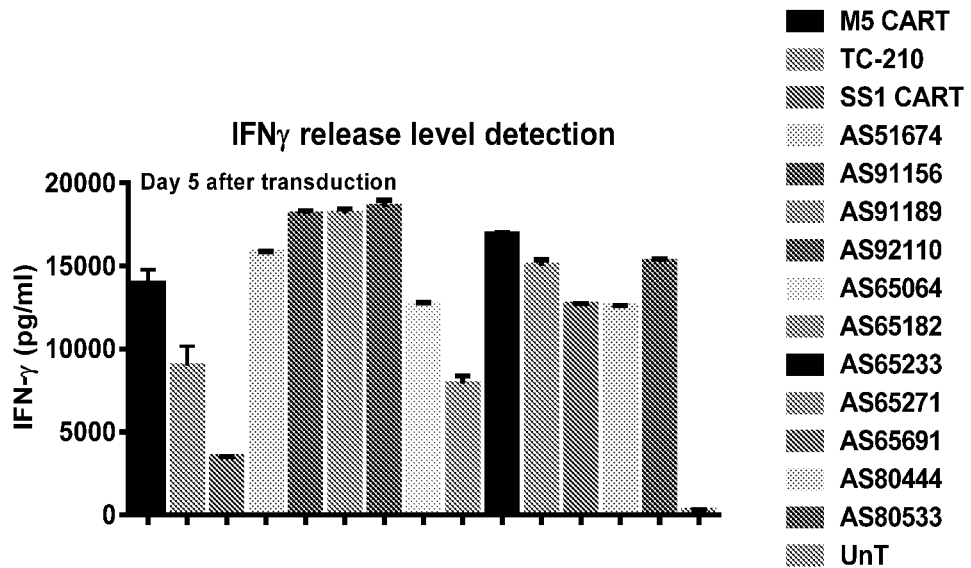

Additionally, supernatant from the in vitro cytotoxicity assay were collected to assess CAR-induced cytokine release, e.g., interferon gamma (IFNγ) release. As shown in FIG. 9 and FIG. 10, M5 CAR-T, AS51674 CAR-T, AS60702 CAR-T, AS91156 CAR-T, AS91189 CAR-T, AS92110 CAR-T, AS65233 CAR-T, AS65271 CAR-T and AS80533 CAR-T were stimulated by OVCAR-8 to produce IFNγ, whereas SS1 CAR-T produced less IFNγ, while UnT produced little IFNγ.

Long-Term Expansion Assay by Repetitive Stimulation

Figure 11:
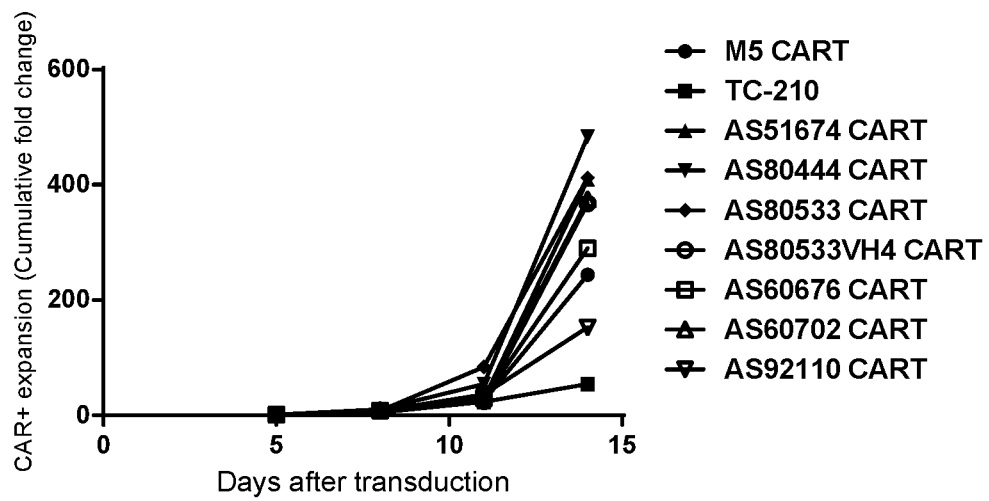
FIG. 11 shows a graph demonstrating long-term expansion of anti-mesothelin CAR-T according to embodiments of the application by repetitive stimulation.

Day 0 (4 days after transduction), $2\times10^5$ OVCAR-8 cells are plated in 6 well plates to establish a monolayer. Day 1, T cells are counted and $1\times10^6$ viable CAR$^+$ T cells are plated on top of the OVCAR-8 cells in fresh media in the absence of cytokines. Day 3, new $2\times10^5$ OVCAR-8 cells monolayers are plated as in day 0. Day 4, viable CAR-T cells are counted. Day 4, $1\times10^6$ CAR$^+$ T cells from wells that expanded (have at least this number of cells) are re-plated on a new monolayer as on day 1. Process is repeated for 3-4 repeat stimulations. Fold expansion after each stimulation is calculated as [viable CAR$^+$ T cells on day 4]/$1\times10^6$, the amount of CAR-T cells plated on day 1 of each stimulation. To normalize for cells discarded with each new stimulation, cumulative fold expansion is determined by [(fold expansion)×(fold expansion+1) . . . ]. As shown in FIG. 11, after 3 rounds of co-culture with target cells, AS51674 CAR-T, AS80444 CAR-T, AS80533 CAR-T, AS80533VH4 CAR-T and AS60702 CAR-T exhibited better expansion capacity than M5 CAR-T and TC-210.

Example 6: Evaluation of Anti-Mesothelin CAR-Ts in In Vivo Mouse Model

Anti-tumor activity of anti-mesothelin CAR-T was assessed in vivo in an OVCAR-8 xenograft model. $10\times10^6$ OVCAR-8 cells were implanted subcutaneously on day 0 in NOD scid gamma (NSG) mice. Once tumors were 150-200 mm$^3$, mice were randomized into treatment groups. $0.33\times10^6$ CAR positive T cells (M5 CAR-T, TC-210, anti-mesothelin CAR-Ts, UnT) in a 200 μl dose was administered intravenously. Mice and tumors were monitored for about 60 days after tumor cell implantation.

Figure 12:
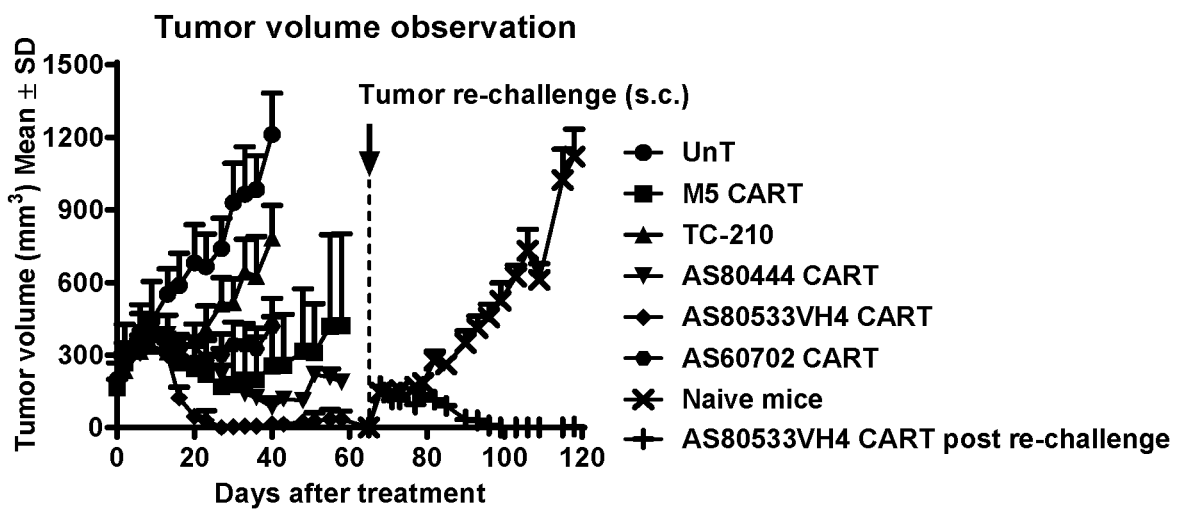
FIG. 12 shows a graph demonstrating anti-tumor efficacy of anti-mesothelin CAR-T according to embodiments of the application in OVCAR-8 xenograft model.

As shown in FIG. 12, AS80533VH4 CAR-Ts efficiently eradicated tumor in mice and led to tumor free. AS80444 CAR-Ts also significantly regressed the tumor in vivo. However, M5 CAR-Ts inhibited the tumor growth by about 50%, whereas TC-210 could hardly inhibit the tumor growth. No tumor inhibitory effect was observed by infusion of UnT. 65 days after CAR-T infusion, $10\times10^6$ OVCAR-8 cells were re-challenged subcutaneously in AS80533VH4 CAR-Ts cured mice. While tumor kept growing in naïve mice, re-challenged tumor was eradicated in AS80533VH4 cured mice. These results demonstrated that AS80533VH4 CAR-Ts eradicate tumor at a relatively a low dose ($0.33\times10^6$ CAR positive T cells) and provide long-term protection (more than 100 days) in vivo.

Example 7: Detection of Follicle Stimulating Hormone Receptor (FSHR) Expression on Ovarian Tumor Cell Lines FSHβ 33-53 peptide (SEQ ID NO:319) was fused with Fc region of human IgG at the C-terminus, then transiently produced and purified from HEK293F cells. Transient expression and purification in HEK293F cells was performed with standard methodology. Briefly, 100 ml of HEK293F cells at $3\times10^6$ cells/ml were transfected with 100 μg plasmid and 300 μg polyethylenimine. The cells were incubated at 37° C. with 8% $CO_2$ and rotated at 80 rpm. After six days, the cells were harvested by centrifugation at 3500×g for 20 minutes. The supernatant was purified by binding Fc fusion FSHβ 33-53 peptide to Protein A agarose beads. The protein was eluted with citrate buffer and dialyzed against phosphate buffered saline (PBS).

Figure 13:
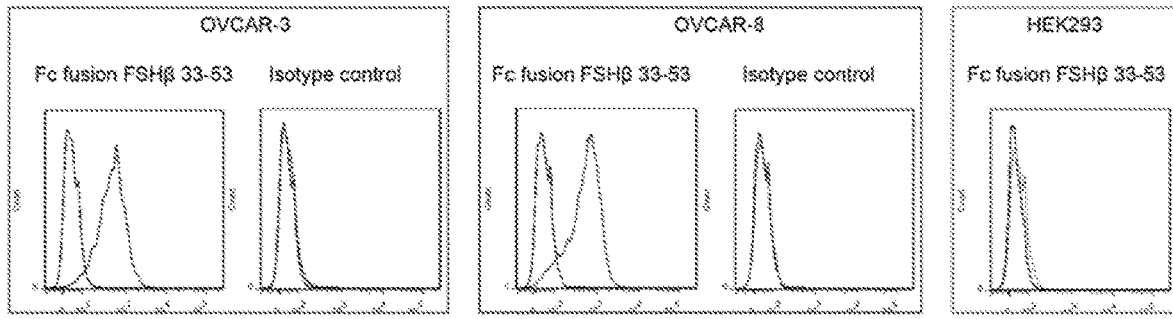
FIG. 13 shows the expression of FSHR on ovarian cancer cell lines via flow cytometric assay.

To confirm expression of FSHR on ovarian tumor cell lines, Fc fusion FSHβ 33-53 peptide (SEQ ID NO:332) was tested for its binding capacity to OVCAR-3 cells, OVCAR-8 cells and HEK293F cells (negative control) via flow cytometric assay. The fluorescence-activated cell sorting (FACS) data (FIG. 13) shows that Fc fusion FSHβ 33-53 peptide specifically binds to OVCAR-3 and OVCAR-8 cells, and does not bind to HEK293 control cells, demonstrating FSHR expression on ovarian tumor cell lines.

Example 8: Preparation of FSHR TCR Complex

Figure 2A:
FIG. 2A is a schematic representation of an FSHR TCR construct.
Figure 2B:
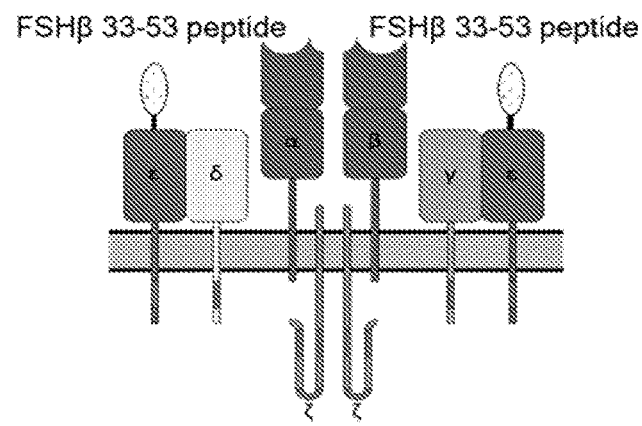
FIG. 2B illustrates the TCR construct anchored in T cell membrane.
Figure 3A:
FIGS. 3A-3D show schematic representations of embodiments of FSHR/mesothelin tandem CAR constructs and illustrations of the constructs anchored in T cell membrane.
Figure 3B:
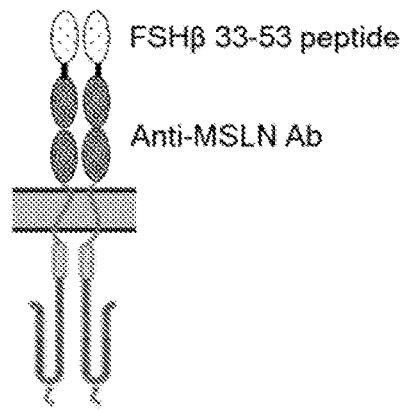
Figure 3C:
Figure 3D:
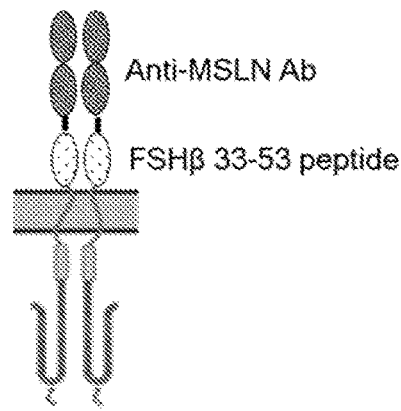
Figure 6A:
Figure 6B:
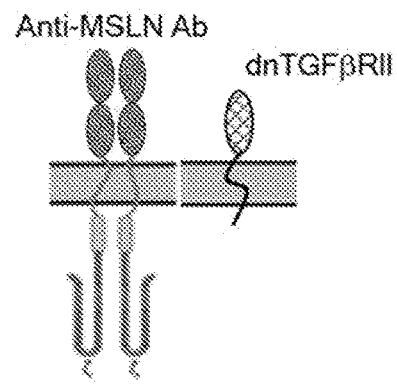
Figure 6C:
Figure 6D:
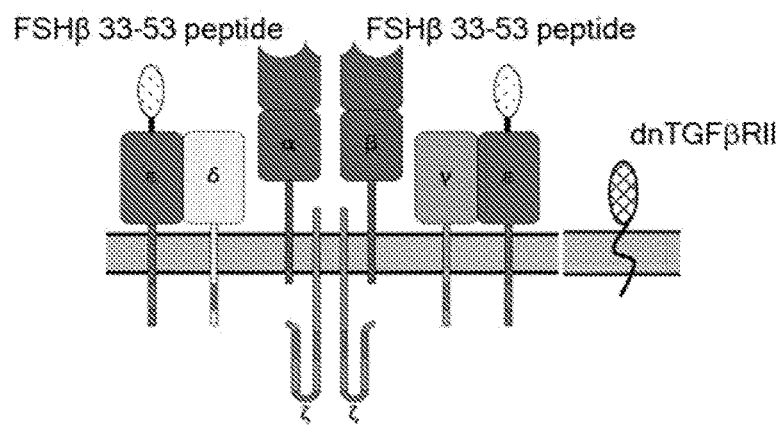
Figure 6E:
Figure 6F:
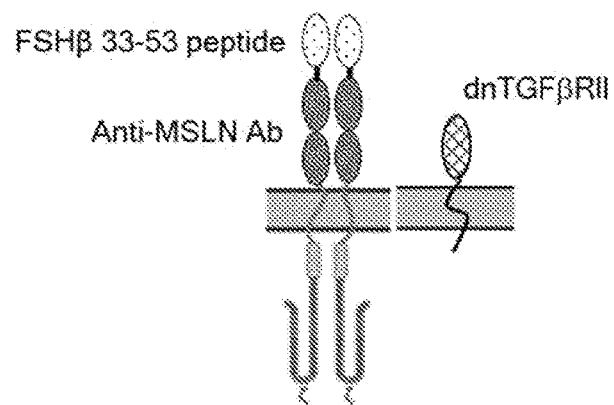
Figure 6G:
Figure 6H:
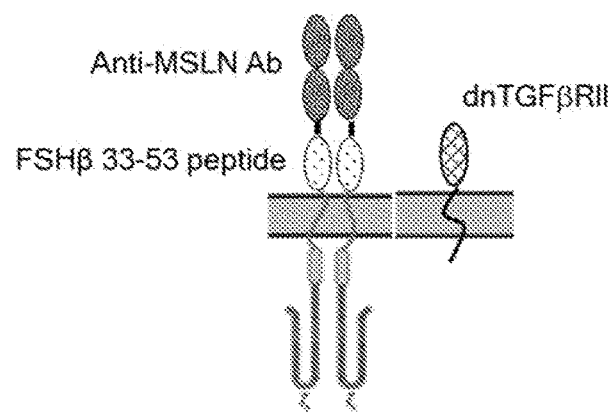

FSHβ 33-53 peptide was fused to CD3 epsilon chain, gamma chain or delta chain for TCR/CD3 complex signaling in a FSHR-dependent and MHC-independent manner. This TCR complex is named as FSHR TCR complex. Thus, a FSHR TCR complex comprises a fusion protein comprising, from the N-terminus to the C-terminus, a CD3ε, CD3γ or CD3δ signal peptide (SEQ ID NO:430-432), FSHβ 33-53 peptide (SEQ ID NO:319), a linker, a CD3ε, CD3γ or CD3δ extracellular domain (SEQ ID NO:433-435), a CD3ε, CD3γ or CD3δ transmembrane domain (SEQ ID NO:436-438), and a CD3ε, CD3γ or CD3δ intracelluar domain (SEQ ID NO:439-441). A schematic representation of a FSHR TCR complex comprising a fusion construct with the FSHβ 33-53 peptide fused to the CD3ε extracellular domain is shown in FIGS. 2A-2B. Similar FSHR TCR complex with the FSHβ 33-53 peptide fused to the CD3γ or CD3δ extracellular domain can also be prepared. The coding sequence for the fusion protein was then cloned into lentiviral vectors to create a FSHR TCR construct in a single coding frame, using human EF1 alpha promoter for expression. The resulting CAR backbone vector was named "PLLV-hEF1α-FSHR TCR."

Example 9: Preparation of FSHR/Mesothelin Tandem CAR Constructs

FSHβ 33-53 peptide was fused to anti-mesothelin CAR between the CD8α signal peptide and the anti-mesothelin scFv or sdAb fragment to generate tandem CAR constructs containing mesothelin and FSHR binding domains. A linker sequence (selected from SEQ ID NOs:334-338) was used to link the C-terminus of the FSHβ 33-53 peptide to the N-terminus of the anti-mesothelin scFv or sdAb fragment. Thus, a full length FSHR/mesothelin tandem CAR contains from the N-terminus to the C-terminus: a CD8α signal peptide, FSHβ 33-53 peptide, a linker, a mesothelin binding domain scFv or sdAb, a CD8α hinge domain, a CD8α transmembrane domain, a CD137 intracellular domain, and a CD3ζ intracellular domain. A schematic representation of the tandem CAR construct is shown in FIGS. 3A-3D. The CAR fragment was then cloned into lentiviral vectors to create a tandem CAR construct in a single coding frame, using human EF1 alpha promoter for expression. The resulting CAR backbone vector was named "PLLV-hEF1α-tandem."

Example 10: Preparation of Mesothelin/FSHR Dual CAR Constructs

FSHβ 33-53 peptide was used to generate a $2^{nd}$ generation CAR construct comprising a CD28 intracellular domain and CD3ζ intracellular domain. The FSHR targeting CAR was then linked to anti-mesothelin CAR at the C-terminus via a 2A element (SEQ ID NO:346). Thus, a full length mesothelin/FSHR dual CAR contains from the N-terminus to the C-terminus: a CD8α signal peptide (SEQ ID NO:340), a mesothelin binding domain scFv or sdAb (SEQ ID NOs: 205-258 and SEQ ID NOs: 420-428), a CD8α hinge domain (SEQ ID NO:341), a CD8α transmembrane domain (SEQ ID NO:342), a CD137 intracellular domain (SEQ ID NO:343), a CD3ζ intracellular domain (SEQ ID NO:345), a 2A element (SEQ ID NO:346), CD8α signal peptide (SEQ ID NO:340), FSHβ 33-53 peptide (SEQ ID NO:319), a CD8α hinge domain (SEQ ID NO:341), a CD8α transmembrane domain (SEQ ID NO:342), a CD28 intracellular domain (SEQ ID NO:344), and a CD3ζ intracellular domain (SEQ ID NO:345). A schematic representation of the dual CAR construct is shown in FIGS. 4A-4B. The CAR fragment was then cloned into lentiviral vectors to create a dual CAR construct in a single coding frame, using human EF1 alpha promoter for expression. The resulting CAR backbone vector was named "PLLV-hEF1α-dual."

Example 11: Preparation of Mesothelin/FSHR CAR/TCR Constructs

The FSHR TCR was then linked to anti-mesothelin CAR at the C-terminus via a 2A element (SEQ ID NO:346). Thus, a full length mesothelin/FSHR CAR/TCR contains from the N-terminus to the C-terminus: a CD8α signal peptide (SEQ ID NO:340), a mesothelin binding domain scFv or sdAb (SEQ ID NOs:205-258 and SEQ ID NOs: 420-428), a CD8α hinge domain (SEQ ID NO:341), a CD8α transmembrane domain (SEQ ID NO:342), a CD137 intracelluar domain (SEQ ID NO:343), a CD3ζ intracelluar domain (SEQ ID NO:345), a 2A element (SEQ ID NO:346), a CD3ε signal peptide (SEQ ID NO:430), FSHβ 33-53 peptide (SEQ ID NO:319), a linker, a CD3ε extracellular domain (SEQ ID NO:433), a CD3ε transmembrane domain (SEQ ID NO:436), and a CD3ε intracelluar domain (SEQ ID NO:439). A schematic representation of the CAR/TCR construct is shown in FIGS. 5A-5B. The CAR fragment was then cloned into lentiviral vectors to create a CAR/TCR construct in a single coding frame, using human EF1 alpha promoter for expression. The resulting CAR backbone vector was named "PLLV-hEF1α-CAR/TCR."

Using similar methods, a mesothelin/FSHR CAR/TCR construct containing a FSHR TCR complex with the FSHβ 33-53 peptide fused to the CD3γ or CD3δ extracellular domain can also be prepared.

Example 12: Preparation of CAR Constructs Armored with dnTGFβRII

The dominant negative TGFβRII (dnTGFβRII) was constructed by truncating the human TGFβRII to remove the intracellular kinase domain at residue 199 as originally reported (SEQ ID NO:347) (Wieser R, et al., *Molecular and cellular biology.* 1993; 13:7239-7247). The dnTGFβRII was linked to a CAR or components of a TCR complex via a P2A element at N-terminus or C-terminus. The dnTGFβRII armored anti-mesothelin CAR, dnTGFβRII armored FSHR TCR, dnTGFβRII armored FSHR/mesothelin tandem CAR, dnTGFβRII armored mesothelin/FSHR dual CAR, dnTGFβRII armored mesothelin/FSHR CAR/TCR were prepared respectively. Schematic representations of dnTGFβRII armored CAR and/or TCR constructs are shown in FIGS. 6A-6L. The nucleic acid encoding a CAR and/or TCR construct was then cloned into a lentiviral vector to create a CAR construct with dnTGFβRII in a single coding frame, using human EF1 alpha promoter for expression. The resulting CAR backbone vector was named "PLLV-hEF1α-dnTGFβRII armored CAR."

Example 13: Evaluation of In Vitro Activities of Different CAR/TCR Constructs Lentivirus containing transgene of different CAR/TCR constructs were prepared as described above. CAR-T cells with different modalities (anti-mesothelin CAR, FSHR TCR, FSHR/mesothelin tandem CAR, mesothelin/FSHR dual CAR, mesothelin/FSHR CAR/TCR, dnTGFβRII armored CAR) were generated by transduction of lentivirus into primary T cells, respectively.

In Vitro Activities of Anti-Mesothelin CARs and FSHR/Mesothelin Tandem CAR

Figure 14:
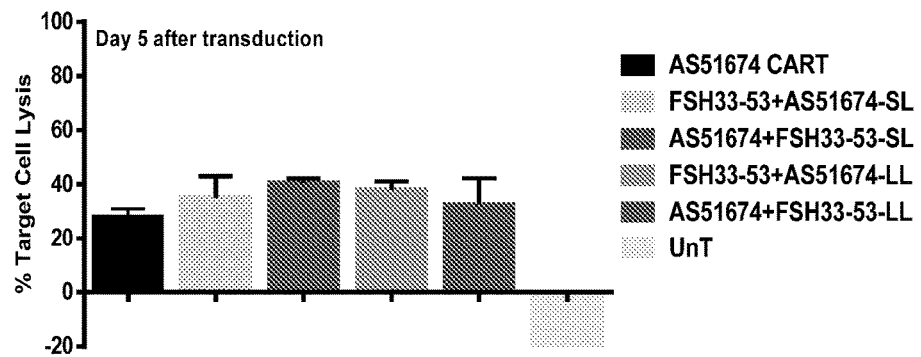
FIG. 14 shows a graph demonstrating FSHR/mesothelin tandem CAR-T according to embodiments of the invention induced killing against OVCAR-8 cells. In the figure, the results for the CARs are depicted in the order as in the legend shown on the right.

In vitro cytotoxicity of AS51674 CAR-T and AS51674 based FSHR/mesothelin tandem CAR-T were evaluated by LDH assay. FSHβ 33-53 peptide was linked to AS51574 via a short linker or a long linker at N-terminus or C-terminus, followed by incorporated with $2^{nd}$ generation CAR construct, corresponding to FSH33-53+AS51674-SL, AS51674+FSH33-53-SL, FSH33-53+AS51674-LL, 51674+FSH33-53-LL, respectively. The results indicated that FSHR/mesothelin tandems CARs had comparable killing efficacy against OVCAR-8 cells to anti-mesothelin CAR, while UnT had no killing effect (FIG. 14).

Figure 15:
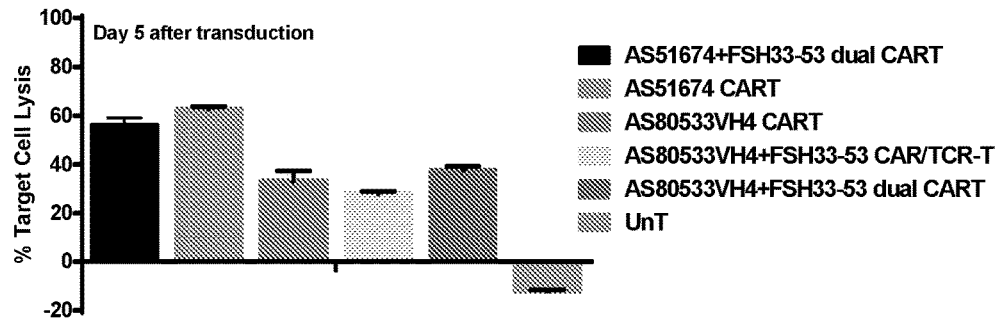
FIG. 15 shows a graph demonstrating mesothelin/FSHR dual CAR-T and mesothelin/FSHR CAR/TCR-T according to embodiments of the application induced killing against OVCAR-8 cells. In the figure, the results for the CARs are depicted in the order as in the legend shown on the right.

In Vitro Activities of Anti-Mesothelin CAR, Mesothelin/FSHR Dual CAR and Mesothelin/FSHR CAR/TCR In vitro cytotoxicity of AS51674 CAR-T, AS51674 based mesothelin/FSHR dual CAR-T, AS80533VH4 CAR-T, AS80533VH4 based mesothelin/FSHR dual CAR-T and AS80533VH4 based mesothelin/FSHR CAR/TCR-T were evaluated by LDH assay. The results indicated that AS51674 based mesothelin/FSHR dual CAR-T had comparable killing efficacy against OVCAR-8 cells to AS51674 CAR-T, AS80533VH4 based mesothelin/FSHR dual CAR-T, AS80533VH4 based mesothelin/FSHR CAR/TCR-T had comparable killing efficacy against OVCAR-8 cells to AS80533VH4 CAR-T, while UnT had no killing effect (FIG. 15).

Figure 16:
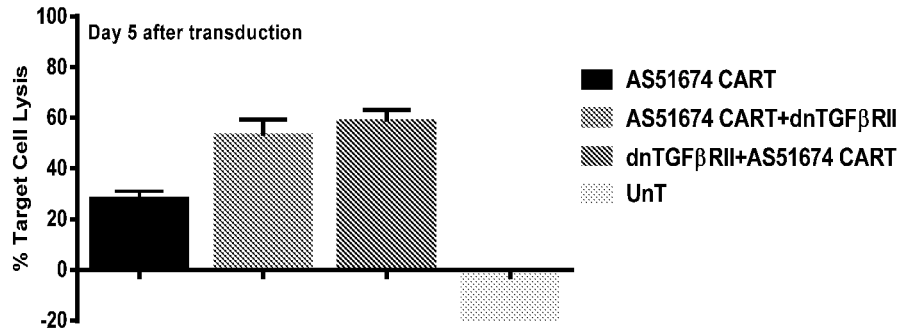
FIGS. 16-17 show graphs demonstrating dnTGFβRII armored CAR-T and naked CAR-T according to embodiments of the application induced killing against OVCAR-8 cells. In each figure, the results for the CARs are depicted in the order as in the legend shown on the right.

In Vitro Activities of Naked (No dnTGFβRII Armored) CAR and dnTGFβRII Armored CAR As described previously, dnTGFβRII was linked to a CAR construct at N-terminus (dnTGFβRII+CAR) or C-terminus (CAR+dnTGFβRII). In vitro cytotoxicity of AS51674 CAR-T and dnTGFβRII armored AS51674 CAR-T were evaluated by LDH assay. The results indicated that dnTGFβRII armored AS51674 CAR-T had better killing efficacy against OVCAR-8 cells than AS51674 CAR-T, while UnT had no killing effect (FIG. 16).

Figure 17:
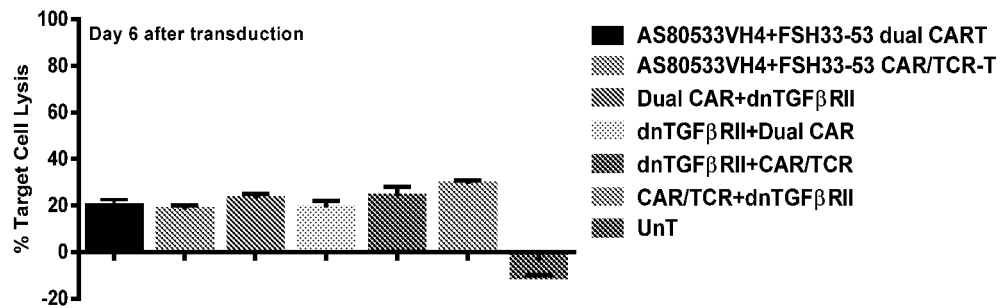

Besides, in vitro cytotoxicity of $AS80533V_H4$ based mesothelin/FSHR dual CAR-T, AS80533 based mesothelin/FSHR CAR/TCR-T and corresponding dnTGFβRII armored CAR-T were evaluated by LDH assay. The results indicated that dnTGFβRII armored CAR-T had comparable killing efficacy against OVCAR-8 cells to naked CAR-T, while UnT had no killing effect (FIG. 17).

Figure 18:
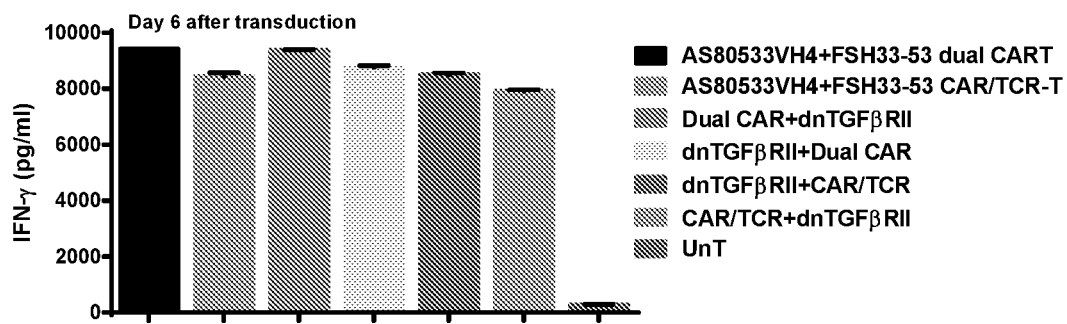
FIGS. 18-19 show graphs demonstrating detected IFNg and TNFa release level upon administration of CAR and/or TCR constructs according to embodiments of the application. In each figure, the results for the CARs are depicted in the order as in the legend shown on the right.
Figure 19:
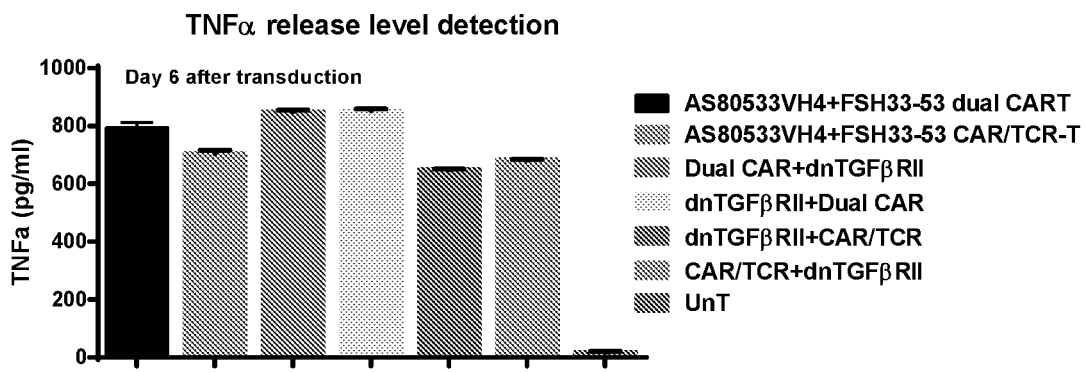

Additionally, supernatant from the in vitro cytotoxicity assay were collected to assess CAR-induced cytokine release, e.g., interferon gamma (IFNγ) and tumor necrosis factor alpha (TNFα) release. As shown in FIG. 18 and FIG. 19, AS80533VH4 based mesothelin/FSHR dual CAR-T, AS80533 based mesothelin/FSHR CAR/TCR-T and corresponding dnTGFβRII armored CAR-T were stimulated by OVCAR-8 to produce comparable level of IFNγ and TNFα, whereas UnT produced little IFNγ and TNFα.

Figure 20:
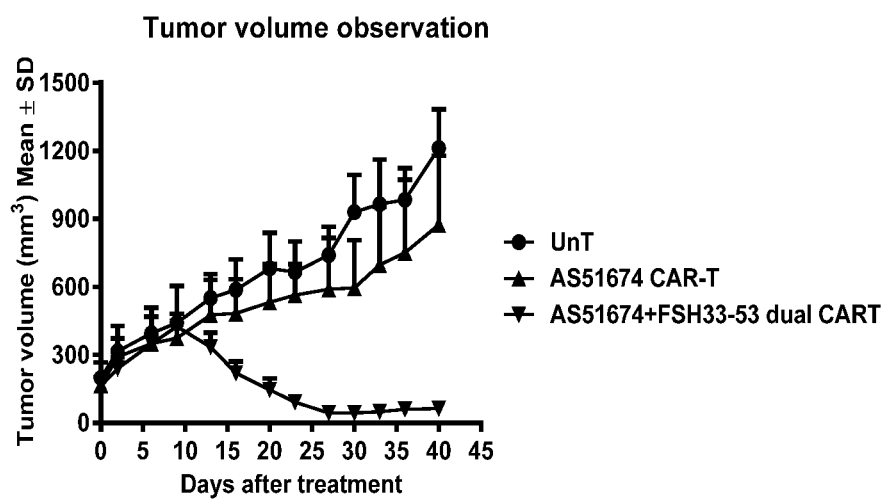
FIGS. 20-21 show graphs demonstrating anti-tumor efficacy of anti-mesothelin CAR-T and mesothlin/FSHR dual CAR-T according to embodiments of the application in OVCAR-8 xenograft model.

Example 14: In Vivo Efficacy Comparison of Anti-Mesothelin CAR and Mesothelin/FSHR Dual CAR Anti-tumor activity of AS51674 CAR-T and AS51674 based mesothelin/FSHR dual CAR-T were assessed in vivo in OVCAR-8 xenograft model. $10 \times 10^6$ OVCAR-8 cells were implanted subcutaneously on day 0 in NSG mice. Once tumors were 150-200 mm$^3$, mice were randomized into treatment groups. $0.33 \times 10^6$ CAR positive T cells in a 200 μl dose was administered intravenously. As shown in FIG. 20, AS51674 based mesothelin/FSHR dual CAR-Ts efficiently eradicated tumor in mice, whereas AS51674 CAR-Ts hardly inhibited the tumor growth. No tumor inhibitory effect was observed by infusion of UnT.

Figure 21:
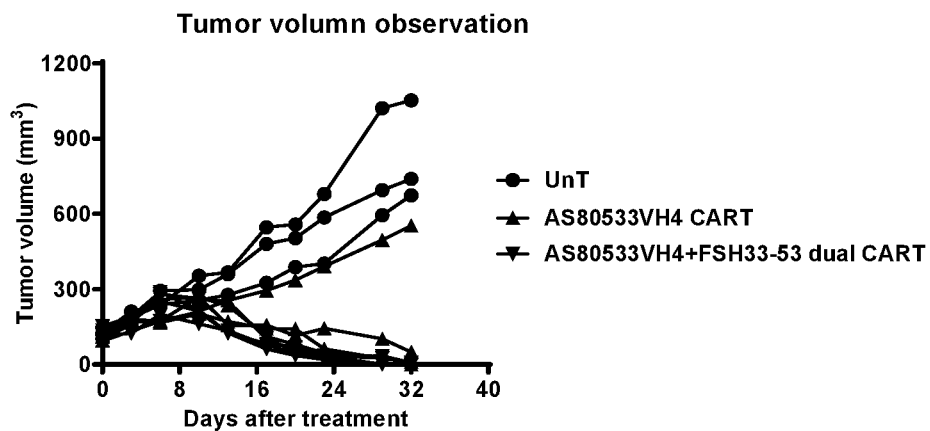

Besides, anti-tumor activity of AS80533VH4 CAR-T and AS80533VH4 based mesothelin/FSHR dual CAR-T were also assessed in vivo in OVCAR-8 xenograft model. Similarly, $0.11 \times 10^6$ CAR positive T cells in a 200 μl dose was administered intravenously into tumor bearing NSG mice when tumor reached 150-200 mm$^3$. As shown in FIG. 21, mesothelin/FHSR dual CAR-Ts efficiently eradicated the tumor in all of 4 mice and led to tumor free, whereas anti-mesothelin CAR-Ts only regressed the tumor in 3 out of 4 mice. No tumor inhibitory effect was observed by infusion of UnT. These results demonstrated that mesothelin/FSHR dual CAR-T had more potent anti-tumor efficacy than anti-mesothelin CAR-T in vivo.

Figure 22:
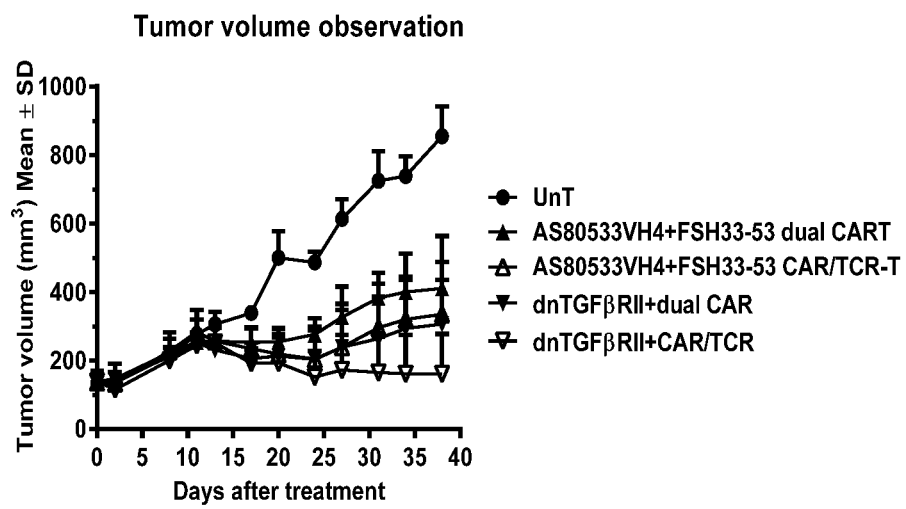
FIG. 22 shows a graph demonstrating anti-tumor efficacy of dnTGFβRII armored CAR-T and naked CAR-T according to embodiments of the application in OVCAR-8 xenograft model

Example 15: In Vivo Efficacy Comparison of Naked CAR and dnTGFβRH Armored CAR Anti-tumor activity of AS80533VH4 based mesothelin/FSHR dual CAR-T, AS80533 based mesothelin/FSHR CAR/TCR-T and corresponding dnTGFβRII armored CAR-T were assessed in vivo in OVCAR-8 xenograft model. Similarly, $0.1 \times 10^6$ CAR positive T cells in a 200 μl dose was administered intravenously into tumor bearing NSG mice when tumor reached 150-200 mm$^3$. As shown in FIG. 22, dnTGFβRII armored CAR-T inhibited the tumor growth more efficiently than corresponding naked CAR-T, for both mesothelin/FSHR dual CAR and mesothelin/FSHR CAR/TCR. Moreover, mesothelin/FSHR CAR/TCR was a little bit more potent than mesothelin/FSHR dual CAR in vivo. No tumor inhibitory effect was observed by infusion of UnT. These results demonstrated that dnTGFβRII armored could enhance the in vivo efficacy of CAR-Ts.

It will be appreciated by those skilled in the art that changes could be made to the embodiments described above without departing from the broad inventive concept thereof. It is understood, therefore, that this invention is not limited to the particular embodiments disclosed, but it is intended to cover modifications within the spirit and scope of the present invention as defined by the present description.

Sequences of Exemplary Constructs According to Embodiments of the Invention:

```
(AD58126 scFv amino acid sequence; CDRs are underlined)
                                                    SEQ ID NO: 205
QVQLKQSGAELAKPGASVEMSCKASGYTFTSYWMHWVKQRPGQGLEWIGYINPSTGHTDYNQKFKDKATLTADKSSSTAY
MQLSSLTSEDSAVYYCARSNWAWFPYWGQGTLVTVSSGGGGSGGGGSGGGGSDIVMTQSPSSLTVTAGEKVTMSCKSSQS
LLNSGNQKNYLTWYQQKPGKPPKLLIYWASTRESGVPDRFTGSGSGTDFTLTISSVQAEDLAVYYCQNDYSYPLTFGSGT
RLEIK (AD58126VH3VL1 scFv amino acid sequence; CDRs are underlined)
                                                    SEQ ID NO: 206
QVQLVQSGAEVKKPGASVKVSCKASGYTFTSYWMHWVKQAPGQGLEWIGYINPSTGHTDYNQKFKDRATLTADTSTSTVY
MELSSLRSEDTAVYYCARSNWAWFPYWGQGTLVTVSSGGGGSGGGGSGGGGSDIVMTQSPDSLAVSLGERATINCKSSQS
LLNSGNQKNYLTWYQQKPGQPPKLLIYWASTRESGVPDRFSGSGSGTDFTLTISSLQAEDVAVYYCQNDYSYPLTFGGGT
KLEIK (AD58116 scFv amino acid sequence; CDRs are underlined)
                                                    SEQ ID NO: 207
QVQLKESGPELVKPGASVKISCKTSGYTFTEYTMNWVRQSHGKSLEWIGGIIPNNGDTSYNQKFKGKATLTVDKSSSTAY
MELRSLTSEDSAVYYCAGRFAYWGQGTLVTVSSGGGGSGGGGSGGGGSDIVMTQAPLTLSVTIGQPASISCKSSQSLLDS
DGKTYLNWFLQRPGQSPKRLIYLVSKLDSGVPDRFTGSGSGTDFTLKISRVEAEDLGVYYCWQGTHFPFTFGSGTKLEIK (AD58117 scFv amino acid sequence; CDRs are underlined)
                                                    SEQ ID NO: 208
QVQLQQSGPELKKPGETVKISCKASFYTFTAYSMHWVKQAPGKGLKWMGWINTETGEPTYADDFKGRFAFSLETSATTAY
LQINNLKNEDTATFFCARGLRRFAYWGQGTLVTVSSGGGGSGGGGSGGGGSDIVMTQSPTSLAVSLGQRATISCRASESV
DSYGNSFMNWYQQKPGQPPKLLIYLASYLESGVPARFSGSGSRTDFTLTIDPVEADDAATYYCQQNNEDPYTFGGGTRLE
IK (AD58127 scFv amino acid sequence; CDRs are underlined)
                                                    SEQ ID NO: 209
QVQLQQSGAELVRPGASVTLSCKASGYTFTDYEIHWVKQTPVHGLEWIGGIDPETGGAAYTQKFKGKATLTADKSSSTAY
MELRSLTSEDSAVYYCTTYGNYPLDSWGQGTTLTVSSGGGGSGGGGSGGGGSGIVMTQTPLSLPVSLGDQASISCRSSQS
LVHSNGNTYLHWYLQKPGQSPKLLIYKVSNRFSGVPDRFSGSGSGTDFTLKISRVEAEDLGVYFCSQSTHVPLTFGAGTR
LEIK (AD58143 scFv amino acid sequence; CDRs are underlined)
                                                    SEQ ID NO: 210
QVQLKQSGAELVRPGASVTLSCKASGYTFTDYEMHWVKQTPVHGLEWIGGIDPETGGAAYTQKFKGKATPTADKSSSTAY
MELRSLTSEDSAVYYCTTYGNYPLDSWGQGTTVTVSSGGGGSGGGGSGGGGSDIQMTQTPLSLPVSLGDQASISCRSSQS
LVHSNGNTYLHWYLQKPGQSPKLLIYKVSNRFSGVPDRFSGSGSGTDFTLKISGVEAEDLGVYFCSQSTHVPLTFGAGTK
LELK (AD58159 scFv amino acid sequence; CDRs are underlined)
                                                    SEQ ID NO: 211
QVQLKQSGAELVRPGTSVKISCKASGYTITNYWLGWVKQRPGHGLEWIGDIYPGGGYTNYNEKFKGKATLTADTSSITAY
MQLSSLTSEDSAVYFCARGGSSYWYFDVWGAGTSVTVSSGGGGSGGGGSGGGGSDIQMTQTTSSLSASLGDRVTISCSAS
QDISNYLNWYQQKPDGTVKLLIYYTSSLHSGVPSRFSGSGSGTDYSLTISNLEPEDIATYYCQQYSKVPYTFGGGTKLEL
K (AD58115 scFv amino acid sequence; CDRs are underlined)
                                                    SEQ ID NO: 212
QVQLKQSGPELVKPGASVKISCKTSGYTFTEYTMNWVKQSHGKSLEWIGGIIPNNGDTSYKQEFKGKATLTVDKSSSTAY
MELRSLTSDDSAVYYCAGRFAYWGQGTLVTVSSGGGGSGGGGSGGGGSDIVMTQTPLTLSVTIGQPASISCKSSQSLLDS
DGKTYLNWFLQRPGQSPKRLIYLVSKLDSGVPDRFTGSGSGTDFTLKISRVEAEDLGVYYCWQGTHFPFTFGSGTKLEIK (AD58123 scFv amino acid sequence; CDRs are underlined)
                                                    SEQ ID NO: 213
EVQLQQSGPGLVAPSQSLSITCTVSGFSLSRYSVHWVRQPPGKGLEWLGMIWGGNTDYNSALKSRLSISKDNSKSQVFL
KMNSLQTDDTAMYYCARSLGWYFDIWGAGTTVTVSSGGGGSGGGGSGGGGSDIVMTQSPSSLAVSAGEKVTMSCKSSQSV
LYSSNQKNYLAWYQQKPGQSPKLLIYWASTRESGVPDRFTGSGSGTDFTLTISSVQAEDLAVYYCHQYLSSWTFGGGTKL
EIK (AD58145 scFv amino acid sequence; CDRs are underlined)
                                                    SEQ ID NO: 214
EVQLQQSGAELAKPGASVKMSCKASGYTFTSYWMHWVKQRPGQGLEWIGYINPSTGYTDYNQKFKDKATLTADKSSSTAY
MQLSSLTSEDSAVYYCARSNWAWFPYWGQGTLVTVSSGGGGSGGGGSGGGGSDIQMTQSPSSLTVTAGEKVTMSCKSSQS
LLNSGNQKNYLTWYQQKPGQPPKLLIYWASTRESGVPDRFTGSGSGTDFTLTISSVQAEDLAVYYCQNDYSYPLTFGAGT
KLELK (AS51489 scFv amino acid sequence; CDRs are underlined)
                                                    SEQ ID NO: 215
EVQLVESGGGLVQPGGSLRLSCAASGFNLYYYSIHWVRQAPGKGLEWVAYISSSSSYTYYADSVKGRFTISADTSKNTAY
LQMNSLRAEDTAVYYCARYYPYYGMDYWGQGTLVTVSSGGGGSGGGGSGGGGSDIQMTQSPSSLSASVGDRVTITCRASQ
SVSSAVAWYQQKPGKAPKLLIYSASSLYSGVPSRFSGSRSGTDFTLTISSLQPEDFATYYCQQGFSYYPITFGQGTKVEI
K
```

-continued (AS51491 scFv amino acid sequence; CDRs are underlined)
SEQ ID NO: 216
EVQLVESGGGLVQPGGSLRLSCAASGFNLYSYSMHWVRQAPGKGLEWVAYIYPYSGSTYYADSVKGRFTISADTSKNTAY
LQMNSLRAEDTAVYYCARGYGMDYWGQGTLVTVSSGGGGSGGGGSGGGGSDIQMTQSPSSLSASVGDRVTITCRASQSVS
SAVAWYQQKPGKAPKLLIYSASSLYSGVPSRFSGSRSGTDFTLTISSLQPEDFATYYCQQSYYWLFTFGQGTKVEIK (AS92110 scFv amino acid sequence; CDRs are underlined)
SEQ ID NO: 217
EVQLVESGGGLVQPGGSLRLSCAASGFNIYYSSMHWVRQAPGKGLEWVAYIYPYYSYTYYADSVKGRFTISADTSKNTAY
LQMNSLRAEDTAVYYCARGYALDYWGQGTLVTVSSGGGGSGGGGSGGGGSDIQMTQSPSSLSASVGDRVTITCRASQSVS
SAVAWYQQKPGKAPKLLIYSASSLYSGVPSRFSGSRSGTDFTLTISSLQPEDFATYYCQQASSGYHYLITFGQGTKVEIK (AS91156 scFv amino acid sequence; CDRs are underlined)
SEQ ID NO: 218
EVQLVESGGGLVQPGGSLRLSCAASGFNIYSSSIHWVRQAPGKGLEWVASISSYSSYTSYADSVKGRFTISADTSKNTAY
LQMNSLRAEDTAVYYCARYYAMDYWGQGTLVTVSSGGGGSGGGGSGGGGSDIQMTQSPSSLSASVGDRVTITCRASQSVS
SAVAWYQQKPGKAPKLLIYSASSLYSGVPSRFSGSRSGTDFTLTISSLQPEDFATYYCQQGPYYHPITFGQGTKVEIK (AS91189 scFv amino acid sequence; CDRs are underlined)
SEQ ID NO: 219
EVQLVESGGGLVQPGGSLRLSCAASGFNLSYSSIHWVRQAPGKGLEWVASIYSYSGSTYYADSVKGRFTISADTSKNTAY
LQMNSLRAEDTAVYYCARYWGMDYWGQGTLVTVSSGGGGSGGGGSGGGGSDIQMTQSPSSLSASVGDRVTITCRASQSVS
SAVAWYQQKPGKAPKLLIYSASSLYSGVPSRFSGSRSGTDFTLTISSLQPEDFATYYCQQYYWYYPITFGQGTKVEIK (AS51674 scFv amino acid sequence; CDRs are underlined)
SEQ ID NO: 220
EVQLVESGGGLVQPGGSLRLSCAASGFNLYSYYMHWVRQAPGKGLEWVASIYSYSSYTSYADSVKGRFTISADTSKNTAY
LQMNSLRAEDTAVYYCARPFGWGYAGMDYWGQGTLVTVSSGGGGSGGGGSGGGGSDIQMTQSPSSLSASVGDRVTITCRA
SQSVSSAVAWYQQKPGKAPKLLIYSASSLYSGVPSRFSGSRSGTDFTLTISSLQPEDFATYYCQQGYAPITFGQGTKVEI
K (AS66073 sdAb amino acid sequence; CDRs are underlined)
SEQ ID NO: 221
QVQLVESGGDSVQAGGSLTLACTGRKYSSLYCMAWFRQAPGKAREGVAVISSGGFTNYADSVKGRFTISRDNSKNTLYLA
MNGLKPEDTAMYYCAAGLSYCHSSTATATYRGQGTQVTVSS (AS66439 sdAb amino acid sequence; CDRs are underlined)
SEQ ID NO: 222
QMQLVESGGGSVQAGGSLRLSCTAPGFTSSDCDMDWYRQAAGNQREWVSSLLSTDGSTSYADSVRGRFTISKDPAKDTVY
LQMNSLKPEDTAMYFCRCVVAEWGGMDYWGKGTLVTVSS (AS65955 sdAb amino acid sequence; CDRs are underlined)
SEQ ID NO: 223
QVHLVESGGGSVQAGGSLRLSCAASGDRVSTGCMGWFRQGPGEEREGLAQIHNYNIAKYADSVKGRFTISKDNAKNILYL
QMNSLKPEDTGLYICTAPVDCSWSMFLQDPLALSPPRGQGTQVTVSS (AS65233 sdAb amino acid sequence; CDRs are underlined)
SEQ ID NO: 224
QVHLVESGGGSVQAGGSLRLSCAASEFTYSMGWFRQAPGKEREGVAHIYTRGGTTVYADSVKGRFVLSRYNAKSIMYLQM
NSVKLEDTAMYYCAARTIFEGSWSSPSSFDFWGQGTQVTVSS (AS65926 sdAb amino acid sequence; CDRs are underlined)
SEQ ID NO: 225
QVQLVESGGGSVQAGGSLRLSCAASGNLYNNMCMGWFRQAPGKEREGVASIYIGGGYTNYADSVKGRFTISPISRDNAKS
TLYLQMNSLKPEDTAMYYCAAVSIALTREFCAPIVSRYNYWGQGTQVTVSS (AS66159 sdAb amino acid sequence; CDRs are underlined)
SEQ ID NO: 226
QVRLVESGGGSVQAGGSLRLSCAASGNVYNNMCMGWFRQAPGKEREGVASIYVGGGYTNYADSVRGRFTISQDNAKNTLY
LQMNSLKPEDTAMYYCAAITVALTRAFCAPIPSRYTNWGQGTQVTVSS (AS66416 sdAb amino acid sequence; CDRs are underlined)
SEQ ID NO: 227
QVQLAESGGGSVQAGGSLRLSCAASGNLYNNMCMGWFRQAPGKEREGVGSIYIGGGYTNYSESVRGRFTISLDNAKKTLN
LQMNSLKPEDTAMYYCAAIPIALTRAFCAPIVSRYTYWGQGTQVTVSS (AS65850 sdAb amino acid sequence; CDRs are underlined)
SEQ ID NO: 228
EVQLMESGGGSVQAGGSLRLSCAASGFSYSNICMGWFRQAPGKEREGVAAIYSNGSTIYADSVKGRFTVSKEFAKNTQYL
QMNSLKPEDTAMYYCAAGRCGGPNYWGQGTQVTVSS (AS65183 sdAb amino acid sequence; CDRs are underlined)
SEQ ID NO: 229
EVQLAESGGGSAQAGGSLRLSCASNGYYNRRYCMAWFRQAPGKEREGVATMTTTSGRTYYADAVKGRFTVSQDNAKSTLY
LQMSSLKPEDTAMYYCAAHLPSSWVTSTDYCDNLQAGFYNSWGQGTQVTVSS (AS65062 sdAb amino acid sequence; CDRs are underlined)
SEQ ID NO: 230
QVHLVESGGGSVQAGGSLRLSCAASGVSVVNFAMRWYRQAPGNEREFVSAMYRSGSTSYADSVRGRFTISRDSALNIVEL
QMSGLKPEDTATYYCQATSPMGDTYWGQGTQVTVSS -continued (AS65065 sdAb amino acid sequence; CDRs are underlined)
SEQ ID NO: 231
EVQLAESGGGSVQAGGSLRLSCAAS<u>GYSYCRSTMRW</u>YRQAPGNVREFVS<u>AIYSDGTTSYTDSVKG</u>RFTISQDNAKNTVYL
QMNSLQPEDTAMYYCRI<u>DLVGCNVAGGSPY</u>WGQGTQVTSS (AS65556 sdAb amino acid sequence; CDRs are underlined)
SEQ ID NO: 232
QVHLVESGGGSVQVGGSLRLSCAAS<u>GYNASICRMSW</u>YRQAPGTEREFVS<u>SSYRDGSQSYADSVKG</u>RFTTSRDSAKNTVFL
QMNSLKPSDTAMYYCNA<u>ACPWRAY</u>WGQGTQVTVSS (AS65069 sdAb amino acid sequence; CDRs are underlined)
SEQ ID NO: 233
QVHLVESGGGSVQAGGSLRLSCVAS<u>GDTGYQPTMRW</u>YRQAPGKEREFVS<u>AIYSDQTTSYADSVKG</u>RFTISQDNARKIVYL
QMASLKPEDTAMYYCKL<u>TTRRGSEY</u>WGQGTQVTVSS (AS65691 sdAb amino acid sequence; CDRs are underlined)
SEQ ID NO: 234
QMQLVESGGGSVQAGGSLRLSCTVS<u>GYTDYRLVLRW</u>YRQALGKEREFIS<u>AIYSDGVTSYSDSVKG</u>RFTISRDNAKNTAYL
QMNSLKSEDTAMYYCKA<u>TGSGGVAY</u>WGQGTQVTVSS (AS65064 sdAb amino acid sequence; CDRs are underlined)
SEQ ID NO: 235
QVQLVESGGGSVQAGGSLKLSCAVS<u>GDTVQTNCMAW</u>FRQAPGKEREAVAS<u>ILSLYSSGGKTVYADSVKG</u>RFTISPDNAQN
TVSLQMNNLKPEDTAMYYCATV<u>RVTVTWAEKLRRCTGFSGMDY</u>WGKGTLVTVSS (AS65081 sdAb amino acid sequence; CDRs are underlined)
SEQ ID NO: 236
QVHLMESGGGSVQAGGSLRLSCAAS<u>GVPASSYCMGW</u>FRQAPGKEREGVAG<u>IVSDTTTTYADSVKG</u>RFTISKDNAKNTLYL
QMNSLKPEDTATYYCAA<u>SHFLLCARKPRWDDLIKYEY</u>WGQGTQVTVSS (AS65115 sdAb amino acid sequence; CDRs are underlined)
SEQ ID NO: 237
QVQLVESGGGSVQAGGSLRLSCAAS<u>GYIYGCMGW</u>FRRAPGKAREEVAT<u>IYRDGTAYYANSVEG</u>RFTASRNNAENTLSLEM
NSLNAEDTAMYYCAA<u>RTTGCNWDISGVY</u>WGQGTQVTVSS (AS65271 sdAb amino acid sequence; CDRs are underlined)
SEQ ID NO: 238
QMQLVESGGGSVQAGGSLTLSCAAS<u>GKTYGRCMAW</u>FRQAPGKERELVAA<u>TYISGGRPYVADSVKG</u>RFTISRDNAKSTMSL
QMNSLRPDDSAMYYCAAG<u>SAGRGPCDRFDQNQYTF</u>WGQGTQVTVSS (AS65166 sdAb amino acid sequence; CDRs are underlined)
SEQ ID NO: 239
QVQLVESGGGSVQAGGSLRLSCTAS<u>EDLSIYGYNCMGW</u>FRQAPGKEREAVAA<u>IYTGRGTTYYADSVKG</u>RFTISQDNAKNT
VYLQMNSLKPEDTAMYYCAS<u>KYCAVVADFGNSRLVRY</u>WGQGTQVTVSS (AS65450 sdAb amino acid sequence; CDRs are underlined)
SEQ ID NO: 240
QVRLVESGGGSVQAGGSLRLSCAAS<u>GDMNGYKCMGW</u>FRQAPGKEREAVAG<u>IYTGRGTTYYADSVKD</u>RFTISQDNAKNTVY
LQMNSLKPEDTAMYYCAA<u>KYCAVVAEFGGPRLVRY</u>WGQGTQVTVSS (AS65454 sdAb amino acid sequence; CDRs are underlined)
SEQ ID NO: 241
QVRLVESGGGSVQAGGSLRLSCAAS<u>GDMNGYKCMGW</u>FRQAPGKEREAVAG<u>IYTGRNTTYYADSVKD</u>LFTISQDNAQNTVE
LQMNSLKPEDTAMYYCAS<u>YCAVVAEFRGPRLDRY</u>WGYGTQVTVTS (AS65131 sdAb amino acid sequence; CDRs are underlined)
SEQ ID NO: 242
EVQLAESGGGSVQAGGSLTLSCTAS<u>EYVTHLGW</u>FRQAPGKEREGVAI<u>ESFRIGYTYYADSVKG</u>RFTISHDNAKNTLYLQM
NSLKPEDTAIYYCAA<u>RQDRSGASMVNRDSYNY</u>WGKGTQVTVSS (AS65182 sdAb amino acid sequence; CDRs are underlined)
SEQ ID NO: 243
QVKLVESGGGSVQAGGSLRLSCAAS<u>GYTYSYGYMGW</u>FRQAPGKEREGVAK<u>IYNGDGSTYYADSVKG</u>RFTISQDRRNNTLY
LQMNSLAPEDTGMYYCAT<u>NRLPNSDVDLVLPRFGRFGY</u>WGQGTQVTVSS (AS60685 sdAb amino acid sequence; CDRs are underlined)
SEQ ID NO: 244
QVQLVESGGGSVQAGGSLRLSCAAS<u>GNVYNNMCMGW</u>FRQAPGKEREGVAS<u>MYVGGGYTYYDDSVKG</u>RFTISRDNAKNTLY
LQMNSLKPEDTAMYYCAA<u>ISIALTREFCAPIVSRYNY</u>WGQGTQVTVSS (AS60702 sdAb amino acid sequence; CDRs are underlined)
SEQ ID NO: 245
QVKLVESGGGSVQAGGSLRLSCAAS<u>GNVYNNMCMGW</u>FRQAPGKEREGVAS<u>IYVGGGYTNYADSVRG</u>RFTISQDNAKNTLY
LQMNSLKPEDTAMYYCAA<u>ITVALTRAFCAPIPSRYTN</u>WGQGTQVTVSS (AS60705 sdAb amino acid sequence; CDRs are underlined)
SEQ ID NO: 246
QVQLVESGGGSVQSGGSLRLSCAAS<u>GYAYSGSCMMAW</u>FRQAPGKEREGVAV<u>SVRRTGSAFYADSVKA</u>RFTISRDNAKNTL
YLQMNNLKVEDTAMYYCAA<u>DFTCRTWTLNKNYNHW</u>GQGTQVTVSS (AS60660 sdAb amino acid sequence; CDRs are underlined)

SEQ ID NO: 247

QVHLMESGGGSVQAGGSLRLSCVAS<u>GDTGYQPTMR</u>WYRQAPGKEREFVS<u>AIYSDQTTSYADSVKG</u>RFTISQDNARKTVYL
QMASLKPEDTAMYYCKL<u>TTRRGSEY</u>WGQGTQVTVSS (AS60662 sdAb amino acid sequence; CDRs are underlined)

SEQ ID NO: 248

QVHLVESGGGSVQAGGSLRLSCVAS<u>GYRNCRSTMR</u>WYRQGPGQVRDWVS<u>SIYTDGTTSYTDSVKG</u>RFTIAQDKGKNTVYL
QMNSLQPEDTAMYYCRI<u>DLVGCNVAGGSPYW</u>GHGTQVTVSS (AS60664 sdAb amino acid sequence; CDRs are underlined)

SEQ ID NO: 249

QVHLVESGGGSVQAGGSLTLSCAAS<u>GKTYGRCMA</u>WFRQAPGKERELVA<u>ATYISGGRPYVADSVKG</u>RFTISRDNAKSTMSL
QMNSLRPDDSAMYYCAA<u>GSAGRGPCDREDQNQYTF</u>WGQGTQVTVSS (AS60668 sdAb amino acid sequence; CDRs are underlined)

SEQ ID NO: 250

QVHLVESGGGSVQAGGSLRLSCAAS<u>GDMNGYKCMG</u>WFRQAPGKEREAVA<u>GIYTGRNTTYYADSVKD</u>RFTISQDNAKNTVF
LQMNSLKPEDTAMYYCAS<u>KYCAVVAEFGGPRLVRY</u>WGQGTQVTVSS (AS60676 sdAb amino acid sequence; CDRs are underlined)

SEQ ID NO: 251

QVQLVESGGGSVQAGGSLRLSCAAS<u>GYTVSSGCMG</u>WFRQAPGKERERVA<u>QIGRDATTTYADSVKG</u>RFTIARDDAENTLYL
QMNSLKPEDTAMYSCTAYWGVYCLS<u>PGRY</u>WGQGTQVTVSS (AS60678 sdAb amino acid sequence; CDRs are underlined)

SEQ ID NO: 252

QVHLVESGGGSVQAGGSLRLSCAVS<u>GYTSSRGCMS</u>WFRQAPGKERERVA<u>YINMRVLTTIYAASVKD</u>RFAISRDNAKNTVD
LQMNNLKPEDTAMYYCAA<u>GYNGQWCEHASDVTAW</u>GQGTQVTVSS (AS60679 sdAb amino acid sequence; CDRs are underlined)

SEQ ID NO: 253

QVHLMESGGGSVQAGGSLRLSCARS<u>GVTYCRLTMR</u>WYRQAPGSEREFVS<u>AIYSDGSTAYADSVKG</u>RFTMSQDDAKNTVYL
QMNSVKPEDTAMYYCKL<u>NCASGLTAW</u>GQGTQVTVSS (AS81326 sdAb amino acid sequence; CDRs are underlined)

SEQ ID NO: 254

EVQLVESGGGSVQAGGSLTLSCAAS<u>ESRDCMAW</u>FRQAPGKAREGVAS<u>IYAPDGSTTYADTVKG</u>RFTISQDNAKNTLYLQM
NSLQPEDAAMYHCAI<u>GGLSRNTCGYLRGGYFAY</u>FGRGTQVTVSS (AS81187 sdAb amino acid sequence; CDRs are underlined)

SEQ ID NO: 255

QVRLVESGGGSVQAGGSLRLSCAAS<u>GYTYSSYSSNCLG</u>WFRQAPGKEREAVA<u>RIYPNSGSTYYADSVKG</u>RFTISQDNAKN
TVYLQMNSLKPEDTAMYYCAV<u>AVGVGDNWCASGAAYFGY</u>WGQGTQVTVSS (AS80533 sdAb amino acid sequence; CDRs are underlined)

SEQ ID NO: 256

QVHLVESGGGSVQTGGSLRLSCTAS<u>GLSFSTYTVAW</u>FRQAPGKEREGVAA<u>IPYTSQHMVYTDSVKG</u>RFTISRDNTKNMVY
LQMNSLKPEDTAMYYCAT<u>DRRPGTSMLAINGYNR</u>WGQGTQVTVSS (AS80444 sdAb amino acid sequence; CDRs are underlined)

SEQ ID NO: 257

EVQLAESGGGSVQAGGSLRLSCAAS<u>GFTFSRNTMG</u>WFRQAPGKEREGVAA<u>IPYTSTGIVYSDSVG</u>GRFTISRDNTKNMVY
LQMNNLEPEDTAMYYCAT<u>DRRPGTTMLAVNGYNH</u>WGQGTQVTVSS (AS81487 sdAb amino acid sequence; CDRs are underlined)

SEQ ID NO: 258

QVRLVESGGGSVQAGGSLRVSCLVS<u>KLTAWRSCVG</u>WFRQAPGKEREGVAA<u>IYSGTGSTYYADSVKG</u>RFTIAQDYAKNMVY
LQMNSLKPEDTAMYCAG<u>TSIRSSCGLVRDEYAY</u>WGQGTQVTVSS (AD58126 scFv nucleic acid sequence)

SEQ ID NO: 259

CAGGTGCAGCTGAAGCAGTCTGGGGCTGAACTGGCAAAACCTGGGGCCTCAGTGGAGATGTCCTGCAAGGCTTCTGGCTA
CACCTTTACTAGCTACTGGATGCACTGGGTAAAACAGAGGCCTGGACAGGGTCTGGAATGGATTGGATACATTAATCCTA
GTACTGGTTATACTGACTACAATCAGAAGTTCAAGGACAAGGCCACATTGACTGCAGACAAATCCTCCAGCACAGCCTAC
ATGCAACTGAGCAGCCTGACATCTGAGGACTCTGCAGTCTATTACTGTGCAAGATCCAACTGGGCCTGGTTTCCTTACTG
GGGCCAAGGGACTCTGGTCACTGTCTCGAGCGGTGGAGGCGGTTCAGGCGGAGGTGGCTCTGGCGGTGGCGGATCGGACA
TTGTGATGACTCAGTCTCCATCCTCCCTGACTGTGACAGCAGGAGAAAAGGTCACTATGAGCTGCAAGTCCAGTCAGAGT
CTGTTAAACAGTGGAAATCAAAAGAACTACTTGACCTGGTACCAGCAGAAACCAGGGAAGCCTCCTAAACTGTTGATCTA
CTGGGCATCCACTAGGGAATCTGGGGTCCCTGATCGCTTCACAGGCAGTGGATCTGGAACAGATTTCACTCTCACCATCA
GCAGTGTGCAGGCTGAAGACCTGGCAGTTTATTACTGTCAGAATGATTATAGTTATCCGCTCACGTTCGGTTCTGGGACC
AGACTGGAAATAAAA (AD58126VH3VL1 scFv nucleic acid sequence)

SEQ ID NO: 260

CAGGTGCAGCTGGTGCAGTCCGGAGCAGAGGTGAAGAAGCCAGGAGCCAGCGTGAAGGTGTCCTGCAAGGCCTCTGGCTA
CACCTTCACAAGCTATTGGATGCACTGGGTGAAGCAGGCACCAGGACAGGGACTGGAGTGGATCGGCTACATCAATCCCT
CCACAGGCCACACCGACTATAACCAGAAGTTTAAGGATCGGGCCACCCTGACAGCCGACACCTCTACAAGCACCGTGTAC
ATGGAGCTGAGCTCCCTGAGGTCCGAGGATACAGCCGTGTACTATTGCGCCCGCTCTAATTGGGCCTGGTTCCCCTATTG
GGGCCAGGGCACACTGGTGACCGTGTCTAGCGGAGGAGGAGGATCCGGAGGAGGAGGATCTGGCGGCGGCGGCAGCGATA

-continued

TCGTGATGACACAGTCCCCTGACTCTCTGGCCGTGTCTCTGGGAGAGAGGGCAACCATCAACTGTAAGTCCTCTCAGAGC
CTGCTGAACTCCGGCAATCAGAAGAACTACCTGACCTGGTATCAGCAGAAGCCTGGCCAGCCCCCTAAGCTGCTGATCTA
CTGGGCATCTACAAGGGAGAGCGGAGTGCCAGATAGATTCTCCGGCTCTGGCAGCGGCACCGACTTTACACTGACCATCA
GCTCCCTGCAGGCCGAGGATGTGGCCGTGTACTATTGTCAGAATGACTACAGCTATCCCCTGACATTTGGCGGCGGCACC
AAGCTGGAGATCAAG (AD58116 scFv nucleic acid sequence)

SEQ ID NO: 261

CAGGTGCAGCTGAAGGAGTCTGGACCTGAGCTGGTGAAGCCTGGGGCTTCAGTGAAGATATCCTGCAAGACTTCTGGATA
CACATTCACTGAATACACCATGAACTGGGTGAGGCAGAGCCATGGAAAGAGCCTTGAGTGGATTGGAGGTATTATTCCTA
ACAATGGTGATACTAGCTACAACCAGAAGTTCAAGGGCAAGGCCACATTGACTGTAGACAAGTCCTCCAGCACAGCCTAC
ATGGAACTCCGCAGCCTGACATCTGAGGATTCTGCAGTCTATTACTGTGCAGGGCGGTTTGCTTACTGGGGCCAAGGGAC
TCTGGTCACTGTCTCGAGCGGTGGAGGCGGTTCAGGCGGAGGTGGCTCTGGCGGTGGCGGGTCGGATATTGTGATGACCC
AGGCTCCACTCACTTTGTCGGTTACCATTGGACAACCAGCCTCCATCTCTTGCAAGTCAAGTCAGAGCCTCTTAGATAGT
GATGGAAAGACATATTTGAATTGGTTCTTACAGAGGCCAGGCCAGTCTCCAAAGCGCCTAATCTATCTGGTGTCTAAACT
GGACTCTGGAGTCCCTGACAGGTTCACTGGCAGTGGATCAGGGACAGATTTCACACTGAAAATCAGCAGAGTGGAGGCTG
AGGATTTGGGAGTTTATTATTGCTGGCAAGGTACACATTTTCCATTCACGTTCGGCTCGGGCACAAAGTTGGAAATAAAA (AD58-1-17 scFv nucleic acid sequence)

SEQ ID NO: 262

CAGGTCCAGCTGCAGCAGTCTGGACCTGAGCTGAAGAAGCCTGGAGAGACCGTCAAGATCTCCTGCAAGGCTTCTTTTTA
TACCTTCACAGCCTATTCAATGCACTGGGTGAAGCAGGCTCCAGGAAAGGGTTTAAAGTGGATGGGCTGGATAAACACTG
AGACTGGTGAGCCAACATATGCAGATGACTTCAAGGGACGGTTTGCCTTCTCTTTGGAAACCTCTGCCACCACTGCCTAT
TTGCAGATCAACAACCTCAAAAATGAGGACACGGCTACATTTTTCTGTGCTAGGGACTACGGCGGTTTGCTTACTGGGG
CCAGGGGACTCTGGTCACTGTCTCGAGCGGTGGAGGCGGTTCAGGCGGAGGTGGCTCTGGCGGTGGCGGGTCGGACATTG
TGATGACACAGTCTCCAACTTCTTTGGCTGTGTCTCTAGGGCAGAGGGCCACCATATCCTGCAGAGCCAGTGAAAGTGTT
GATAGTTATGGCAATAGTTTTATGAATTGGTACCAGCAGAAACCAGGACAGCCACCCAAACTCCTCATCTATCTTGCATC
CTACCTAGAATCGGGGTCCCTGCCAGGTTCAGTGGCAGTGGGTCTAGGACAGACTTCACCCTCACCATTGATCCTGTGG
AGGCTGATGATGCTGCAACCTATTACTGTCAGCAAAATAATGAGGATCCGTACACGTTCGGAGGGGGGACCAGACTGGAA
ATAAAA (AD58127 scFv nucleic acid sequence)

SEQ ID NO: 263

CAGGTTCAGCTGCAGCAGTCTGGGGCTGAACTGGTGAGGCCTGGGGCTTCAGTGACGCTGTCCTGCAAGGCTTCGGGCTA
CACATTTACTGACTATGAAATTCACTGGGTGAAGCAGACACCTGTGCATGGCCTGGAATGGATTGGAGGTATTGATCCTG
AAACTGGTGGTGCTGCCTACACTCAGAAGTTCAAGGGCAAGGCCACACTGACTGCAGACAAATCCTCCAGCACAGCCTAC
ATGGAGCTCCGCAGCCTGACATCTGAGGACTCTGCCGTCTATTACTGTACAACTTATGGTAACTACCCCTTGACTCCTG
GGGCCAAGGCACCACTCTCACAGTCTCGAGCGGTGGAGGCGGTTCAGGCGGAGGTGGCTCTGGCGGTGGCGGGTCGGTA
TTGTGATGACCCAGACTCCACTCTCCCTGCCTGTCAGTCTTGGAGATCAAGCCTCCATCTCTTGCAGATCTAGTCAGAGC
CTTGTACACAGTAATGGAAACACCTATTTACATTGGTACCTGCAGAAGCCAGGCCAGTCTCCAAAGCTCCTGATCTACAA
AGTTTCCAACCGATTTTCTGGGGTCCCAGACAGGTTCAGTGGCAGTGGATCAGGGACAGATTTCACACTCAAGATCAGCA
GAGTGGAGGCTGAGGATCTGGGAGTTTATTTCTGCTCTCAAAGTACACATGTTCCGCTCACGTTCGGTGCTGGGACCAGA
CTGGAAATAAAA (AD58143 scFv nucleic acid sequence)

SEQ ID NO: 264

CAGGTGCAACTGAAGCAGTCTGGGGCTGAACTGGTGAGGCCTGGGGCTTCAGTGACGCTGTCCTGCAAGGCTTCGGGCTA
CACATTTACTGACTATGAAATGCACTGGGTGAAGCAGACACCTGTGCATGGCCTGGAATGGATCGGAGGTATTGATCCTG
AAACTGGTGGTGCTGCCTACACTCAGAAGTTCAAGGGCAAGGCCACACCGACTGCAGACAAATCCTCCAGCACAGCCTAC
ATGGAGCTCCGCAGCCTGACATCTGAGGACTCTGCCGTCTATTACTGTACAACTTATGGTAACTACCCCTTGACTCCTG
GGGCCAAGGCACCACGGTCACCGTCTCGAGCGGTGGAGGCGGTTCAGGCGGAGGTGGCTCTGGCGGTGGCGGGTCGGATA
TCCAGATGACACAGACTCCACTCTCCCTGCCTGTCAGTCTTGGAGATCAAGCCTCCATCTCTTGCAGATCTAGTCAGAGC
CTTGTACACAGTAATGGAAACACCTATTTACATTGGTACCTGCAGAAGCCAGGCCAGTCTCCAAAGCTCCTGATCTACAA
AGTTTCCAACCGATTTTCTGGGGTCCCAGACAGGTTCAGTGGCAGTGGATCAGGGACAGATTTCACACTCAAGATCAGCG
GAGTGGAGGCTGAGGATCTGGGAGTTTATTTCTGCTCTCAAAGTACACATGTTCCGCTCACGTTCGGTGCTGGGACCAAG
CTGGAGCTGAAA (AD58159 scFv nucleic acid sequence)

SEQ ID NO: 265

CAGGTGCAACTGAAGCAGTCTGGAGCTGAGCTGGTAAGGCCTGGGACTTCAGTGAAGATATCCTGCAAGGCTTCTGGCTA
CACCATCACTAACTACTGGCTAGGTTGGGTAAAGCAGAGGCCAGGACATGGACTTGAGTGGATTGGAGATATTTACCCTG
GAGGTGGTTATACTAACTACAATGAGAAGTTCAAGGGCAAGGCCACACTGACTGCAGACACATCCTCCATCACTGCCTAC
ATGCAGCTCAGTAGCCTGACATCTGAGGACTCTGCTGTCTATTCTGTGCAAGAGGCGGTAGTAGCTACTGGTACTTCGA
TGTCTGGGGCGCAGGGACCTCAGTCACCGTCTCGAGCGGTGGAGGCGGTTCAGGCGGAGGTGGCTCTGGCGGTGGCGGGT
CGGATATCCAGATGACACAGACTACATCCTCCCTGTCTGCCTCTCTGGGAGACAGAGTCACCATCAGTTGCAGTCAAGT
CAGGACATTAGCAATTATTTAAACTGGTATCAGCAGAAACAGATGGAACTGTTAAACTCCTGATCTATTACACATCAAG
TTTACACTCAGGAGTCCCATCAAGGTTCAGTGGCAGTGGGTCTGGGACAGATTATTCTCTCACCATCAGCAACCTGGAAC
CTGAAGATATTGCCACTTACTATTGTCAGCAGTATAGTAAGGTTCCGTACACGTTCGGAGGGGGGACCAAGCTGGAGCTG
AAA (AD58115 scFv nucleic acid sequence)

SEQ ID NO: 266

CAGGTGCAGCTGAAGCAGTCTGGACCTGAGCTGGTGAAGCCTGGGGCTTCAGTGAAGATATCCTGCAAGACTTCTGGATA
CACATTCACTGAATACACCATGAACTGGGTGAAGCAGAGCCATGGAAAGAGCCTTGAGTGGATTGGAGGAATTATTCCTA
ACAATGGTGATACTAGCTACAAACAGGAGTTCAAGGGCAAGGCCACATTGACTGTAGACAAGTCCTCCAGCACAGCCTAC
ATGGAGCTCCGCAGCCTGACATCTGACGATTCTGCAGTCTATTACTGTGCAGGGCGGTTTGCTTACTGGGGCCAAGGGAC
TCTGGTCACTGTCTCGAGCGGTGGAGGCGGTTCAGGCGGAGGTGGCTCTGGCGGTGGCGGGTCGGATATTGTGATGACCC
AGACTCCACTCACTTTGTCGGTTACCATTGGACAACCAGCCTCCATCTCTTGCAAGTCAAGTCAGAGCCTCTTAGATAGT
GATGGAAAGACATATTTGAATTGGTTCTTACAGAGGCCAGGCCAGTCTCCAAAGCGCCTAATCTATCTGGTGTCTAAACT
GGACTCTGGAGTCCCTGACAGGTTCACTGGCAGTGGATCAGGGACAGATTTCACACTGAAAATCAGCAGAGTGGAGGCTG
AGGATTTGGGAGTTTATTATTGCTGGCAAGGTACACATTTTCCATTCACGTTCGGCTCGGGCACAAAGTTGGAAATAAAA

-continued (AD58123 scFv nucleic acid sequence)
SEQ ID NO: 267
GAGGTCCAGCTGCAGCAGTCAGGACCTGGCCTGGTGGCACCCTCACAGAGCCTGTCCATCACATGCACTGTCTCTGGGTT
CTCATTATCCAGATATAGTGTACACTGGGTTCGCCAGCCTCCAGGAAAGGGTCTGGAGTGGCTGGGAATGATATGGGGTG
GTGGAAACACAGACTATAATTCAGCTCTCAAATCCAGACTGAGCATCAGCAAGGACAACTCCAAGAGCCAAGTTTTCTTA
AAAATGAACAGTCTGCAAACTGATGACACAGCCATGTACTACTGTGCCAGAAGCCTGGGCTGGTACTTCGATATCTGGGG
CGCAGGGACCACGGTCACCGTCTCGAGCGGTGGAGGCGGTTCAGGCGGAGGTGGCTCTGGCGGTGGCGGGTCGGACATTG
TGATGACACAGTCGCCATCATCTCTGGCTGTGTCTGCAGGAGAAAAGGTCACTATGAGCTGTAAGTCCAGTCAAAGTGTT
TTATACAGTTCAAATCAGAAGAACTACTTGGCCTGGTACCAGCAGAAACCAGGGCAGTCTCCTAAACTGCTGATCTACTG
GGCATCCACTAGGGAATCTGGTGTCCCTGATCGCTTCACAGGCAGTGGATCTGGGACAGATTTTACTCTTACCATCAGCA
GTGTACAAGCTGAAGACCTGGCAGTTTATTACTGTCATCAATACCTCTCCTCGTGGACGTTCGGTGGAGGCACAAAGCTG
GAAATCAAA (AD58145 scFv nucleic acid sequence)
SEQ ID NO: 268
GAGGTTCAGCTGCAACAGTCTGGGGCTGAACTGGCAAAACCTGGGGCCTCAGTGAAGATGTCCTGCAAGGCTTCTGGCTA
CACCTTTACTAGCTACTGGATGCACTGGGTAAAACAGAGGCCTGGACAGGGTCTGGAATGGATTGGATACATTAATCCTA
GCACTGGTTATACTGACTACAATCAGAAGTTCAAGGACAAGGCCACATTGACTGCAGACAAATCCTCCAGCACAGCCTAC
ATGCAACTGAGCAGCCTGACATCTGAGGACTCTGCAGTCTATTACTGTCAAGATCCAACTGGGCCTGGTTTCCTTACTG
GGGCCAAGGGACTCTGGTCACTGTCTCGAGCGGTGGAGGCGGTTCAGGCGGAGGTGGCTCTGGCGGTGGCGGGTCGGACA
TCCAGATGACACAGTCTCCATCCTCCCTGACTGTGACAGCAGGAGAGAAGGTCACTATGAGCTGCAAGTCCAGTCAGAGT
CTGTTAAACAGTGGAAATCAAAAGAACTACTTGACCTGGTACCAGCAGAAACCAGGGCAGCCTCCTAAACTGTTGATCTA
CTGGGCATCCACTAGGGAATCTGGGGTCCCTGATCGCTTCACAGGCAGTGGATCTGGAACAGATTTCACTCTCACCATCA
GCAGTGTGCAGGCTGAAGACCTGGCAGTTTATTACTGTCAGAATGATTATAGTTATCCGCTCACGTTCGGTGCTGGGACC
AAGCTGGAGCTGAAA SEQ ID NO: 269
(AS51489 scFv nucleic acid sequence)
GAGGTTCAACTGGTGGAGAGCGGTGGTGGTCTGGTTCAGCCGGGTGGTAGCCTGCGTCTGAGCTGCGCAGCTTCTGGCTT
CAACCTCTATTATTATTCTATCCACTGGGTGCGTCAGGCGCGGGTAAAGGCCTGGAATGGGTTGCATATATTTCTTCTT
CTTCTAGCTATACTTATTATGCCGATAGCGTCAAGGGCCGTTTCACCATCAGCGCGGATACCAGCAAAAACACCGCATAC
CTGCAAATGAACAGCCTGCGTGCGGAAGATACCGCCGTCTATTATTGTGCTCGCTACTACCCGTACTACGGTATGGACTA
CTGGGGTCAAGGCACCCTGGTTACCGTGAGCAGCGGTGGAGGCGGTTCAGGCGGAGGTGGCTCTGGCGGTGGCGGGTCGG
ACATCCAGATGACCCAGAGCCCGAGCAGCCTGAGCGCGAGCGTTGGTGACCGTGTTACCATTACCTGCCGTGCGAGCCAG
AGCGTTAGCAGCGCGGTGGCGTGGTACCAGCAAAAGCCGGGTAAAGCGCCGAAGCTGCTGATCTATAGCGCGAGCAGCCT
GTATAGCGGCGTTCCGAGCCGTTTCAGCGGTAGCCGTAGCGGCACCGACTTTACCCTGACCATTAGCAGCCTGCAGCCGG
AAGATTTCGCAACTTATTACTGTCAGCAAGGITTCTCTTACTACCCGATCACGTTCGGACAGGGCACCAAAGITGAGATT
AAA (AS51491 scFv nucleic acid sequence)
SEQ ID NO: 270
GAGGTTCAACTGGTGGAGAGCGGTGGTGGTCTGGTTCAGCCGGGTGGTAGCCTGCGTCTGAGCTGCGCAGCTTCTGGCTT
CAACCTCTATTCTTATTCTATGCACTGGGTGCGTCAGGCGCGGGTAAAGGCCTGGAATGGGTTGCATATATTTATCCTT
ATTCTGGCTCTACTTATTATGCCGATAGCGTCAAGGGCCGTTTCACCATCAGCGCGGATACCAGCAAAAACACCGCATAC
CTGCAAATGAACAGCCTGCGTGCGGAAGATACCGCCGTCTATTATTGTGCTCGCGGTTACGGTATGGACTACTGGGGTCA
AGGCACCCTGGTTACCGTGAGCAGCGGTGGAGGCGGTTCAGGCGGAGGTGGCTCTGGCGGTGGCGGGTCGGACATCCAGA
TGACCCAGAGCCCGAGCAGCCTGAGCGCGAGCGTTGGTGACCGTGTTACCATTACCTGCCGTGCGAGCCAGAGCGTTAGC
AGCGCGGTGGCGTGGTACCAGCAAAAGCCGGGTAAAGCGCCGAAGCTGCTGATCTATAGCGCGAGCAGCCTGTATAGCGG
CGTTCCGAGCCGTTTCAGCGGTAGCCGTAGCGGCACCGACTTTACCCTGACCATTAGCAGCCTGCAGCCGGAAGATTTCG
CAACTTATTACTGTCAGCAATCTTACTACTGGCTGTTCACGTTCGGACAGGGCACCAAAGTTGAGATTAAA (AS92110 scFv nucleic acid sequence)
SEQ ID NO: 271
GAGGTTCAACTGGTGGAGAGCGGTGGTGGTCTGGTTCAGCCGGGTGGTAGCCTGCGTCTGAGCTGCGCAGCTTCTGGCTT
CAACATCTATTATTCTTCTATGCACTGGGTGCGTCAGGCGCGGGTAAAGGCCTGGAATGGGTTGCATATATTTATCCTT
ATTATAGCTATACTTATTATGCCGATAGCGTCAAGGGCCGTTTCACCATCAGCGCGGATACCAGCAAAAACACCGCATAC
CTGCAAATGAACAGCCTGCGTGCGGAAGATACCGCCGTCTATTATTGTGCTCGCGGTTACGCTTTGGACTACTGGGGTCA
AGGCACCCTGGTTACCGTGAGCAGCGGTGGAGGCGGTTCAGGCGGAGGTGGCTCTGGCGGTGGCGGGTCGGACATCCAGA
TGACCCAGAGCCCGAGCAGCCTGAGCGCGAGCGTTGGTGACCGTGTTACCATTACCTGCCGTGCGAGCCAGAGCGTTAGC
AGCGCGGTGGCGTGGTACCAGCAAAAGCCGGGTAAAGCGCCGAAGCTGCTGATCTATAGCGCGAGCAGCCTGTATAGCGG
CGTTCCGAGCCGTTTCAGCGGTAGCCGTAGCGGCACCGACTTTACCCTGACCATTAGCAGCCTGCAGCCGGAAGATTTCG
CAACTTATTACTGTCAGCAAGCTTCTTCTGGTTACCATTACCTGATCACGTTCGGACAGGGCACCAAAGTTGAGATTAAA (AS91156 scFv nucleic acid sequence)
SEQ ID NO: 272
GAGGTTCAACTGGTGGAGAGCGGTGGTGGTCTGGTTCAGCCGGGTGGTAGCCTGCGTCTGAGCTGCGCAGCTTCTGGCTT
CAACATCTATTCTTCTTCTATCCACTGGGTGCGTCAGGCGCGGGTAAAGGCCTGGAATGGGTTGCATATCTATTTCTT
ATTCTAGCTATACTTCTTATGCCGATAGCGTCAAGGGCCGTTTCACCATCAGCGCGGATACCAGCAAAAACACCGCATAC
CTGCAAATGAACAGCCTGCGTGCGGAAGATACCGCCGTCTATTATTGTGCTCGCTACTACGCTATGGACTACTGGGGTCA
AGGCACCCTGGTTACCGTGAGCAGCGGTGGAGGCGGTTCAGGCGGAGGTGGCTCTGGCGGTGGCGGGTCGGACATCCAGA
TGACCCAGAGCCCGAGCAGCCTGAGCGCGAGCGTTGGTGACCGTGTTACCATTACCTGCCGTGCGAGCCAGAGCGTTAGC
AGCGCGGTGGCGTGGTACCAGCAAAAGCCGGGTAAAGCGCCGAAGCTGCTGATCTATAGCGCGAGCAGCCTGTATAGCGG
CGTTCCGAGCCGTTTCAGCGGTAGCCGTAGCGGCACCGACTTTACCCTGACCATTAGCAGCCTGCAGCCGGAAGATTTCG
CAACTTATTACTGTCAGCAAGGTCCGTACTACCATCCGATCACGTTCGGACAGGGCACCAAAGTTGAGATTAAA (AS91189 scFv nucleic acid sequence)
SEQ ID NO: 273
GAGGTTCAACTGGTGGAGAGCGGTGGTGGTCTGGTTCAGCCGGGTGGTAGCCTGCGTCTGAGCTGCGCAGCTTCTGGCTT
CAACCTCTCTTATTCTTCTATCCACTGGGTGCGTCAGGCGCGGGTAAAGGCCTGGAATGGGTTGCATCTATTTATTCTT
ATTCTGGCTCTACTTATTATGCCGATAGCGTCAAGGGCCGTTTCACCATCAGCGCGGATACCAGCAAAAACACCGCATAC CTGCAAATGAACAGCCTGCGTGCGGAAGATACCGCCGTCTATTATTGTGCTCGCTACTGGGGTATGGACTACTGGGGTCA
AGGCACCCTGGTTACCGTGAGCAGCGGTGGAGGCGGTTCAGGCGGAGGTGGCTCTGGCGGTGGCGGGTCGGACATCCAGA
TGACCCAGAGCCCGAGCAGCCTGAGCGCGAGCGTTGGTGACCGTGTTACCATTACCTGCCGTGCGAGCCAGAGCGTTAGC
AGCGCGGTGGCGTGGTACCAGCAAAAGCCGGGTAAAGCGCCGAAGCTGCTGATCTATAGCGCGAGCAGCCTGTATAGCGG
CGTTCCGAGCCGTTTCAGCGGTAGCCGTAGCGGCACCGACTTTACCCTGACCATTAGCAGCCTGCAGCCGGAAGATTTCG
CAACTTATTACTGTCAGCAATACTACTGGTACTACCCGATCACGTTCGGACAGGGCACCAAAGTTGAGATTAAA (AS51674 scFv nucleic acid sequence)
SEQ ID NO: 274
GAGGTTCAACTGGTGGAGAGCGGTGGTGGTCTGGTTCAGCCGGGTGGTAGCCTGCGTCTGAGCTGCGCAGCTTCTGGCTT
CAACCTCTATTCTTATTATATGCACTGGGTGCGTCAGGCGCCGGGTAAAGGCCTGGAATGGGTTGCATCTATTTATTCTT
ATTCTAGCTATACTTCTTATGCCGATAGCGTCAAGGGCCGTTTCACCATCAGCGCGGATACCAGCAAAAACACCGCATAC
CTGCAAATGAACAGCCTGCGTGCGGAAGATACCGCCGTCTATTATTGTGCTCGCCGTTCGGTTGGGGTTACGCTGGTAT
GGACTACTGGGGTCAAGGCACCCTGGTTACTGTGAGCAGCGGTGGAGGCGGTTCAGGCGGAGGTGGCTCTGGCGGTGGCG
GGTCGGACATCCAGATGACCCAGAGCCCGAGCAGCCTGAGCGCGAGCGTTGGTGACCGTGTTACCATTACCTGCCGTGCG
AGCCAGAGCGTTAGCAGCGCGGTGGCGTGGTACCAGCAAAAGCCGGGTAAAGCGCCGAAGCTGCTGATCTATAGCGCGAG
CAGCCTGTATAGCGGCGTTCCGAGCCGTTTCAGCGGTAGCCGTAGCGGCACCGACTTTACCCTGACCATTAGCAGCCTGC
AGCCGGAAGATTTCGCAACTTATTACTGTCAGCAAGGTTACGCTCCGATCACGTTCGGACAGGGCACCAAAGTTGAGATT
AAA (AS66073 sdAb nucleic acid sequence)
SEQ ID NO: 275
CAGGTTCAGCTGGTGGAGTCTGGGGGAGACTCGGTGCAGGCTGGGGGGTCTCTGACACTCGCCTGTACAGGGCGTAAATA
CAGCAGTCTATACTGCATGGCCTGGTTCCGCCAGGCTCCAGGGAAGGCGCGCGAGGGGGTCGCAGTTATTAGCAGTGGCG
GCTTCACAAATTACGCTGACTCCGTAAAGGGCCGATTCACCATCTCCAGAGACAACTCCAAGAACACGCTGTATCTGGCA
ATGAACGGCCTGAAACCTGAGGACACTGCCATGTACTACTGTGCGGCAGGCCTATCCTATTGCCATTCAAGCACAGCAAC
CGCCACGTACCGGGGCCAGGGGACCCAGGTCACCGTCTCCTCA (AS66439 sdAb nucleic acid sequence)
SEQ ID NO: 276
CAGATGCAGCTGGTGGAGTCTGGGGGAGGCTCGGTGCAGGCTGGGGGGTCTCTGAGACTCTCCTGCACAGCCCCTGGATT
CACCTCCAGTGACTGCGACATGGACTGGTACCGCCAGGCTGCAGGGAATCAGCGCGAATGGGTCTCATCTCTTCTTAGTA
CTGACGGTAGCACAAGCTATGCGGACTCCGTGAGGGGCCGATTCACCATCTCCAAAGACCCAGCCAAGGACACGGTGTAT
CTGCAAATGAACAGCCTGAAACCTGAGGCACACGGCCATGTATTTCTGTAGGTGTGTCGTGGCTGAGTGGGGCGGCATGGA
CTACTGGGGCAAAGGAACCCTGGTCACCGTCTCCTCA (AS65955 sdAb nucleic acid sequence)
SEQ ID NO: 277
CAGGTGCACCTGGTGGAGTCTGGGGGAGGCTCGGTGCAGGCTGGAGGGTCTCTGAGACTCTCCTGTGCAGCCTCTGGCGA
CCGCGTCAGTACTGGCTGTATGGGCTGGTTCCGCCAGGGTCCAGGCGAGGAGCGCGAGGGGCTCGCACAAATTCACAATT
ATAATATCGCAAAGTACGCAGACTCCGTGAAGGGCCGATTCACCATCTCCAAAGACAACGCCAAGAACATTCTGTATCTG
CAAATGAACAGCCTGAAACCTGAGGACACTGGCTTGTACATCTGTACGGCTCCTGTAGATTGTAGCTGGAGCATGTTTCT
GCAAGACCCACTTGCGTTGTCTCCACCTAGGGGCCAGGGGACCCAGGTCACCGTCTCCTCA (AS65233 sdAb nucleic acid sequence)
SEQ ID NO: 278
CAGGTGCACCTGGTGGAGTCTGGGGGAGGCTCGGTGCAGGCTGGAGGGTCTCTGAGACTCTCCTGTGCAGCCTCTGAATT
CACGTACAGTATGGGCTGGTTCCGCCAGGCTCCAGGGAAGGAGCGCGAGGGCGTCGCACATATTTACACTCGTGGTGGTA
CCACGGTCTATGCCGACTCCGTGAAGGGCCGATTCGTCCTCTCCCGATCAACGCCAAGAGCATAATGTATCTACAAATG
AACAGCGTGAAACTTGAGGACACTGCCATGTATTACTGTGCGGCCCGGACCATATTCGAAGGTAGCTGGTCGTCCCCATC
CTCGTTTGACTTCTGGGGCCAGGGGACCCAGGTCACCGTCTCCTCA (AS65926 sdAb nucleic acid sequence)
SEQ ID NO: 279
CAGGTGCAGCTGGTGGAGTCTGGGGGAGGCTCGGTGCAGGCTGGAGGGTCTCTGAGACTCTCCTGTGCAGCCTCTGGAAA
CCTCTACAATAACATGTGCATGGGCTGGTTCCGGCAGGCTCCAGGGAAGGAGCGCGAGGGGGTCGCAAGTATTTATATTG
GTGGTGGTTACACCAACTATGCCGACTCCGTGAAGGGCCGATTCACCATCTCCCCATCTCCCGAGACAACGCCAAGAGC
ACGCTGTATCTGCAAATGAACAGCCTGAAACCTGAGGACACTGCCATGTACTACTGTGCGGCAGTCTCCATCGCGCTTAC
GAGGGAATTCTGCGCCCCGATCGTTTCTCGGTATAATTACTGGGGCCAGGGGACCCAGGTCACCGTCTCCTCA (AS66159 sdAb nucleic acid sequence)
SEQ ID NO: 280
CAGGTGAGGTTGGTGGAGTCTGGGGGAGGCTCGGTGCAGGCTGGAGGGTCTCTGAGACTCTCATGTGCAGCCTCTGGAAA
CGTCTACAATAACATGTGCATGGGCTGGTTCCGCCAGGCTCCAGGGAAGGAGCGCGAGGGGGTCGCAAGTATCTATGTTG
GTGGTGGTTACACCAACTATGCCGACTCCGTGAGGGGCCGATTCACCATCTCCAAGACAACGCCAAGAACACGCTGTAT
CTGCAAATGAACAGCCTGAAACCTGAGGACACTGCCATGTACTACTGTGCGGCAATTACCGTCGCGCTTACGAGGGCTTT
CTGCGCCCCGATCCCTTCTCGGTATACCAACTGGGGCCAGGGGACCCAGGTCACCGTCTCCTCA (AS66416 sdAb nucleic acid sequence)
SEQ ID NO: 281
CAGGTGCAGCTGGCGGAGTCTGGGGGAGGTTCGGTGCAGGCTGGAGGGTCTCTGAGACTCTCCTGTGCAGCCTCTGGAAA
CCTCTACAATAACATGTGCATGGGCTGGTTCCGCCAGGCTCCAGGGAAGGAGCGCGAGGGGTCGGAAGTATTTATATTG
GTGGTGGTTACACCAACTATTCCGAATCCGTGAGGGGCCGATTCACCATCTCCCTAGACAACGCCAAGAAGACGCTGAAT
CTGCAAATGAACAGCCTGAAACCTGAGGACACTGCCATGTACTACTGTGCGGCAATCCCCATCGCGCTTACGAGGGCTTT
CTGCGCCCCGATCGTTTCTCGGTATACGTACTGGGGCCAGGGGACCCAGGTCACCGTCTCCTCA (AS65850 sdAb nucleic acid sequence)
SEQ ID NO: 282
GAGGTGCAGCTGATGGAGTCTGGGGGAGGCTCGGTGCAGGCTGGAGGGTCTCTGAGACTCTCCTGTGCAGCCTCTGGATT
CTCCTACAGTAACATCTGTATGGGCTGGTTCCGCCAGGCTCCAGGGAAGGAGCGCGAGGGGGTCGCGGCTATTTATAGTA
ATGGTAGCACAATCTACGCAGACTCCGTGAAGGGCCGATTCACCGTCTCCAAAGAATTCGCCAAGAACACTCAGTATCTG CAAATGAACAGCCTGAAACCTGAGGACACTGCCATGTACTACTGTGCGGCAGGCCGGTGTGGGGGCCCTAACTACTGGGG
CCAGGGGACCCAGGTCACCGTCTCCTCA (AS65183 sdAb nucleic acid sequence)
SEQ ID NO: 283
GAGGTGCAACTGGCGGAGTCTGGGGGAGGCTCGGCGCAGGCTGGAGGGTCTCTGAGACTCTCCTGTGCAAGCAATGGGTA
CTACAACCGTCGCTATTGTATGGCCTGGTTCCGCCAGGCTCCAGGGAAGGAGCGCGAGGGGGTCGCGACTATGACTACTA
CTAGTGGTCGCACATACTATGCCGACGCCGTGAAGGGCCGATTCACCGTCTCCCAAGACAACGCCAAGTCCACGCTGTAT
CTGCAAATGAGCAGCCTGAAACCTGAGGACACTGCCATGTACTACTGTGCGGCGCACCTTCCCAGTTCTTGGGTGACGTC
GACTGATTACTGCGACAACTTGCAAGCCGGCTTTTATAACTCCTGGGGCCAGGGGACCCAGGTCACCGTCTCCTCA (AS65062 sdAb nucleic acid sequence)
SEQ ID NO: 284
CAGGTGCACCTGGTGGAGTCTGGGGGAGGCTCGGTGCAGGCTGGAGGGTCTCTGAGACTCTCCTGTGCAGCCTCTGGAGT
CAGCGTGGTTAACTTCGCCATGAGGTGGTACCGCCAGGCTCCAGGGAACGAGCGCGAGTTCGTCTCAGCGATGTACCGTT
CTGGTAGCACGTCTTACGCTGACTCCGTGAGGGGCCGATTCACCATCTCCCGAGACAGCGCCTTGAACACGGTGTTTCTT
CAAATGAGCGGCCTGAAACCTGAGGACACGGCCACGTATTACTGTCAAGCGACATCACCTATGGGCGACACCTACTGGGG
CCAGGGGACCCAGGTCACCGTCTCCTCA (AS65065 sdAb nucleic acid sequence)
SEQ ID NO: 285
GAGGTGCAACTGGCGGAGTCTGGGGGAGGCTCGGTGCAGGCTGGAGGGTCTCTGAGACTCTCCTGTGCAGCCTCTGGATA
CAGCTACTGTAGGTCCACCATGCGCTGGTACCGCCAGGCTCCAGGGAACGTGCGCGAATTTGTCTCAGCTATCTATAGTG
ATGGTACCACAAGCTACACAGACTCCGTGAAGGGCCGATTCACCATCTCCCAAGACAACGCCAAGAACACTGTGTATCTA
CAAATGAACAGCCTGCAACCTGAAGACACGGCCATGTATTACTGTCGGATAGATCTTGTCGGATGCAACGTAGCTGGTGG
CAGTCCTTACTGGGGCCAGGGGACCCAGGTCACCGTCTCCTCA (AS65556 sdAb nucleic acid sequence)
SEQ ID NO: 286
CAGGTGCACCTGGTGGAGTCTGGGGGAGGCTCGGTGCAGGTTGGAGGGTCTCTGAGACTCTCCTGTGCAGCCTCTGGATA
CAACGCCTCTATCTGCCGCATGAGCTGGTACCGCCAGGCTCCCGGGACTGAGCGCGAGTTCGTCTCATCGTCTTACAGGG
ATGGTAGCCAAAGCTACGCAGACTCCGTGAAGGGGCCGATTCACCACATCCCGAGACTCCGCCAAGAACACGGTGTTTCTG
CAAATGAACAGCCTGAAACCTTCGGACACGGCCATGTATTACTGTAACGCAGCTTGCCCCTGGCGGGCCTACTGGGGCCA
GGGGACCCAGGTCACCGTCTCCTCA (AS65069 sdAb nucleic acid sequence)
SEQ ID NO: 287
CAGGTGCACCTGGTGGAGTCTGGGGGAGGCTCGGTGCAGGCTGGAGGGTCTCTGAGACTCTCCTGTGTAGCCTCTGGAGA
CACCGGCTACCAACCTACGATGAGGTGGTACCGCCAGGCTCCAGGGAAGGAGCGCGAGTTCGTCTCCGCTATTTATAGTG
ATCAGACCACAAGCTATGCAGACTCCGTGAAGGGCCGGTTCACCATCTCCCAAGACAACGCCAGAAAAACGGTGTATCTG
CAAATGGCTAGCCTGAAACCTGAGGACACGGCCATGTATTACTGTAAACTCACTACTCGCAGGGGGTCTGAGTACTGGGG
CCAGGGGACACAGGTCACCGTCTCCTCA (AS65691 sdAb nucleic acid sequence)
SEQ ID NO: 288
CAGATGCAGCTGGTGGAGTCTGGGGGAGGCTCGGTGCAGGCTGGAGGGTCTCTGAGACTCTCCTGTACAGTCTCTGGATA
CACCGACTATAGGCTCGTACTGAGGTGGTACCGCCAGGCTCCAGGGAAGGAGCGCGAGTTCATCTCAGCTATTTATAGTG
ATGGAGTCACAAGCTACTCAGACTCCGTGAAGGGCCGATTCACCATCTCCCGAGACAACGCCAAGAACACGGCGTATCTG
CAAATGAACAGCCTGAAATCTGAGGACACGGCCATGTATTACTGTAAAGCAACCGGGTCCGGTGGCGTTGCCTACTGGGG
CCAGGGAACCCAGGTCACCGTCTCCTCA (AS65064 sdAb nucleic acid sequence)
SEQ ID NO: 289
CAGGTTCAGCTGGTGGAGTCTGGGGGAGGCTCGGTGCAGGCTGGAGGGTCTCTGAAACTCTCCTGTGCAGTCTCTGGAGA
CACCGTCCAGACTAACTGTATGGCCTGGTTCCGCCAGGCTCCAGGGAAGGAGCGCGAGGCGGTCGCCAGCATTTTGAGTC
TTTATTCTAGTGGAGGTAAGACAGTCTATGCCGACTCCGTGAAGGGCCGATTCACCATCTCCCCAGACAACGCCCAGAAC
ACGGTGTCGCTGCAAATGAACAATTTGAAACCTGAGGACACTGCCATGTACTACTGTGCGACTGTCCGCGTGACCGTCAC
TTGGGCCGAAAAGTTGAGGCGTTGTACCGGATTCAGCGGCATGGACTACTGGGGCAAAGGAACCCTGGTCACCGTCTCCT
CA (AS65081 sdAb nucleic acid sequence)
SEQ ID NO: 290
CAGGTGCACCTGATGGAGTCTGGGGGAGGCTCGGTGCAGGCTGGAGGGTCTCTGAGACTCTCCTGTGCAGCCTCTGGAGT
CCCCGCTAGTAGCTACTGCATGGGCTGGTTCCGCCAGGCTCCAGGGAAGGAGCGCGAGGGGGTCGCAGGTATTGTCAGTG
ATACTACCACAACCTACGCAGACTCCGTGAAGGGCCGATTCACCATCTCCAAAGACAACGCCAAGAACACTCTGTATCTG
CAAATGAACAGCCTGAAACCTGAGGACACTGCCACGTACTACTGTGCGGCCTCCCATTTTCTATTGTGCGCCAGAAAACC
CCGCTGGGATGACCTCATTAAATATGAGTACTGGGGCCAGGGGACCCAGGTCACCGTCTCCTCA (AS65115 sdAb nucleic acid sequence)
SEQ ID NO: 291
CAGGTTCAGCTGGTGGAGTCTGGGGGAGGCTCGGTGCAGGCTGGAGGGTCTCTGCGACTCTCCTGTGCAGCCTCTGGATA
CATTTACGGCTGCATGGGCTGGTTCCGCCAGGCTCCAGGGAAGGCGCGAGGAGGITGCGACTATTTACCGCGATGGTA
CAGCATACTACGCAAACTCCGTAGAGGGCCGATTCACCGCCTCCAGAAACAACGCCGAGAACACTCTGTCTCTGGAGATG
AACAGTCTGAACGCTGAGGACACTGCCATGTACTACTGTGCGGCAAGAACAACTGGTTGTAACTGGGACATATCGGGGT
TTACTGGGGCCAGGGGACCCAGGTCACCGTCTCCTCA (AS65271 sdAb nucleic acid sequence)
SEQ ID NO: 292
CAGATGCAGCTGGTGGAGTCTGGGGGAGGCTCGGTGCAGGCTGGAGGGTCTCTGACACTCTCCTGTGCAGCCTCTGGAAA
AACCTACGGACGCTGCATGGCCTGGTTCCGCCAGGCTCCAGGGAAGGAGCGCGAGTTAGTCGCTGCTACTTATATTAGTG
GTGGGCGACCCTACGTTGCCGACTCCGTGAAGGGCCGATTCACCATTTCCCGGGACAACGCCAAGAGTACGATGTCTCTG CAAATGAACAGCCTGAGACCTGACGACAGCGCCATGTACTACTGTGCGGCGGGTTCGGCGGGTCGGGGACCTTGTGATCG
CTTCGACCAAAATCAATATACCTTCTGGGGCCAGGGGACCCAGGTCACCGTCTCCTCA (AS65166 sdAb nucleic acid sequence)
SEQ ID NO: 293
CAGGTGCAGCTGGTGGAGTCTGGGGGAGGCTCGGTGCAGGCTGGAGGGTCTCTGAGACTCTCCTGTACAGCCTCTGAAGA
CTTATCTATTTACGGTTACAATTGCATGGGCTGGTTCCGCCAGGCTCCAGGGAAGGAGCGCGAGGCGGTCGCAGCTATTT
ATACTGGCCGTGGTACCACATACTATGCCGACTCCGTGAAGGGCCGATTCACCATCTCCCAAGACAACGCCAAGAACACT
GTGTATCTGCAAATGAACAGCCTGAAACCTGAGGACACTGCCATGTACTACTGTGCGTCAAAATACTGTGCGGTGGTAGC
TGATTTCGGGAATTCTCGACTCGTTCGTTACTGGGGCCAGGGGACCCAGGTCACCGTCTCCTCA (AS65450 sdAb nucleic acid sequence)
SEQ ID NO: 294
CAGGTGAGGITAGTGGAGTCTGGGGGAGGCTCGGTGCAGGCTGGAGGGTCTCTGAGACTCTCCTGTGCAGCCTCTGGAGA
CATGAACGGTTACAAGTGCATGGGGTGGTTCCGCCAGGCTCCAGGGAAGGAGCGCGAGGCGGTCGCAGGTATTTATACTG
GCCGTGGGACCACATACTATGCCGACTCCGTGAAGGACCGATTCACCATCTCCCAAGACAACGCCAAGAACACTGTGTAT
CTGCAAATGAACAGCCTGAAACCTGAGGACACTGCCATGTACTACTGTGCAGCAAATACTGTGCGGTGGTAGCTGAATT
CGGGGGTCCTCGACTCGTTCGTTACTGGGGCCAGGGGACCCAGGTCACCGTCTCCTCA (AS65454 sdAb nucleic acid sequence)
SEQ ID NO: 295
CAGGTGAGGTTGGTGGAGTCTGGGGGAGGCTCGGTGCAGGCTGGAGGGTCTCTGAGACTGTCCTGTGCAGCCTCTGGAGA
CATGAACGGTTACAAGTGCATGGGGTGGTTCCGCCAGGCTCCAGGGAAGGAGCGAGAGGCGGTCGCAGGTATTTATACTG
GCCGTAATACTACATACTATGCCGACTCCGTGAAGGACCTATTCACCATCTCCCAAGACAACGCCTAGAACACTGTGTTT
CTGCAAATGAACAGCCTGAAACCTGAGGACACTGCCATGTACTACTGTGCGTCATAATACTGTGCGGTGGTAGCTGAATT
CCGGGGTCCTCGACTCGATCGTTACTGGGGCTATGGGACCCAGGTCACCGTCACCTCA (AS65131 sdAb nucleic acid sequence)
SEQ ID NO: 296
GAGGTGCAGCTGGCGGAGTCTGGGGGAGGCTCGGTGCAGGCTGGAGGGTCTCTGACACTCTCCTGTACAGCCTCTGAATA
CGTCACACACTTGGGCTGGTTCCGCCAGGCTCCAGGGAAGGAGCGCGAGGGGGTCGCAATCGAAAGTTTTCGTATTGGTT
ATACATACTATGCCGACTCCGTGAAGGGTCGATTCACCATCTCCCACGACAACGCCAAGAACACGCTGTATCTGCAAATG
AACAGCCTGAAACCTGAGGACACTGCCATATACTACTGTGCGGCTCGGCAGGACCGATCGGGGGCTTCCATGGTAAATCG
AGATTCATATAATTACTGGGGCAAGGGGACCCAGGTCACCGTCTCCTCA (AS65182 sdAb nucleic acid sequence)
SEQ ID NO: 297
CAGGTGAAGTTAGTGGAGTCAGGGGGAGGCTCGGTGCAGGCTGGAGGGTCTCTGAGACTCTCCTGTGCAGCGTCTGGATA
CACGTACAGTTACGGCTACATGGGCTGGTTCCGGCAGGCTCCAGGGAAGGAGCGCGAGGGGGTCGCAAAGATTTATAATG
GTGACGGTAGTACATACTATGCCGACTCCGTGAAGGGCCGATTCACCATCTCCCAAGACCGCCGCAACAACACGCTGTAT
CTGCAAATGAACAGTCTGGCACCTGAGGACACTGGCATGTACTACTGTGCGACAAACCGACTCCCAAATAGCGACGTTGA
CTTGGTCCTTCCCCGGTTCGGCCGTTTTGGTTACTGGGGCCAGGGGACCCAGGTCACCGTCTCCTCA (AS60685 sdAb nucleic acid sequence)
SEQ ID NO: 298
CAGGTGCAGCTGGTGGAGTCTGGGGGAGGCTCGGTGCAGGCTGGAGGGTCTCTGAGACTCTCCTGTGCAGCCTCTGGTAA
TGTCTACAATAACATGTGCATGGGCTGGTTCCGCCAGGCTCCAGGGAAGGAGCGCGAGGGGGTCGCAAGTATGTATGTTG
GTGGTGGTTACACCTACTATGACGACTCCGTGAAGGGCCGATTCACCATCTCCCGAGACAACGCCAAGAACACGCTGTAT
CTGCAAATGAACAGCCTGAAACCTGAAGACACTGCCATGTACTACTGTGCGGCAATCTCCATCGCGCTTACGAGGGAATT
CTGCGCCCCGATCGTTTCTCGGTATAATTATTGGGGCCAGGGGACCCAGGTCACCGTCTCCTCA (AS60702 sdAb nucleic acid sequence)
SEQ ID NO: 299
CAGGTGAAGTTGGTGGAGTCTGGGGGAGGCTCGGTGCAGGCTGGAGGGTCTCTGAGACTCTCATGTGCAGCCTCTGGAAA
CGTCTACAATAACATGTGCATGGGCTGGTTCCGCCAGGCTCCAGGGAAGGAGCGCGAGGGGGTCGCAAGTATCTATGTTG
GTGGTGGTTACACCAACTATGCCGACTCCGTGAGGGGCCGATTCACCATCTCCCAAGACAACGCCAAGAACACGCTGTAT
CTGCAAATGAACAGCCTGAAACCTGAGGACACTGCCATGTACTACTGTGCGGCAATTACCGTCGCGCTTACGAGGGCTTT
CTGCGCCCCGATCCCTTCTCGGTATACCAACTGGGGCCAGGGGACCCAGGTCACCGTCTCCTCA (AS60705 sdAb nucleic acid sequence)
SEQ ID NO: 300
CAGGTGCAGCTGGTGGAGTCTGGGGGAGGCTCGGTGCAGTCTGGAGGGTCTCTGAGACTCTCCTGTGCAGCCTCTGGATA
CGCCTACAGTGGGTCTTCATGATGGCCTGGTTCCGCCAGGCTCCAGGGAAGGAGCGCGAGGGGGTCGCAGTTAGCGTTC
GTCGTACGGGAAGCGCATTCTATGCCGACTCCGTGAAGGGCCGATTCACCATCTCCCGCGACAATGCCAAGAACACGCTG
TATCTGCAAATGAATAACCTGAAAGTTGAGGACACTGCCATGTACTACTGTGCGGCAGATTTTACTTGTCGTACGTGGAC
TCTCAATAAAAATTACAACCACTGGGGCCAGGGGACCCAGGTCACCGTCTCCTCA (AS60660 sdAb nucleic acid sequence)
SEQ ID NO: 301
CAGGTGCACCTGATGGAGTCTGGGGGAGGCTCGGTGCAGGCTGGAGGGTCTCTGAGACTCTCCTGTGTAGCCTCTGGAGA
CACCGGCTACCAACCTACGATGAGGTGGTACCGCCAGGCTCCAGGGAAGGAGCGCGAGTTCGTCTCCGCTATTTATAGTG
ATCAGACCACAAGCTATGCAGACTCCGTGAAGGGCCGGTTCACCATCTCCCAAGACAACGCCAGAAAACGGTGTATCTG
CAAATGGCTAGCCTGAAACCTGAGGACACGGCCATGTATTACTGTAAACTCACTACTCGCAGGGGGTCTGAGTACTGGG
CCAGGGGACACAGGTCACCGTCTCCTCA -continued (AS60662 sdAb nucleic acid sequence)
SEQ ID NO: 302
CAGGTGCACCTGGTGGAGTCTGGGGGAGGCTCGGTGCAGGCTGGAGGGTCTCTGAGACTCTCCTGTGTAGCCTCTGGATA
CAGGAACTGTAGGTCCACCATGCGCTGGTACCGCCAGGGTCCAGGAGCAGGTGCGAGACTGGGTCTCAAGTATCTATACTG
ATGGTACCACAAGCTACACAGACTCCGTGAAGGGCCGATTCACCATCGCCCAAGACAAAGGCAAGAACACGGTGTATCTA
CAAATGAACAGCCTGCAACCTGAAGACACGGCCATGTATTACTGTCGGATAGATCTTGTCGGATGCAATGTAGCTGGTGG
CAGTCCTTACTGGGGCCATGGGACCCAGGTCACCGTCTCCTCA (AS60664 sdAb nucleic acid sequence)
SEQ ID NO: 303
CAGGTGCACCTGGTGGAGTCTGGGGGAGGCTCGGTGCAGGCTGGAGGGTCTCTGACACTCTCCTGTGCAGCCTCTGGAAA
AACCTACGGACGCTGCATGGCCTGGTTCCGCCAGGCTCCAGGGAAGGAGCGCGAGTTAGTCGCTGCTACTTATATTAGTG
GTGGGCGACCCTACGTTGCCGACTCCGTGAAGGGCCGATTCACCATTTCCCGGGACAACGCCAAGAGTACGATGTCTCTG
CAAATGAACAGCCTGAGACCTGACGACAGCGCCATGTACTACTGTGCGGCGGGTTCGGCGGGTCGGGGACCTTGTGATCG
CTTCGACCAAAATCAATATACCTTCTGGGGCCAGGGGACCCAGGTCACCGTCTCCTCA (AS60668 sdAb nucleic acid sequence)
SEQ ID NO: 304
CAGGTGCACCTGGTGGAGTCTGGGGGAGGCTCGGTGCAGGCTGGAGGGTCTCTGAGACTGTCCTGTGCAGCCTCTGGAGA
CATGAACGGTTACAAGTGCATGGGGTGGTTCCGCCAGGCTCCAGGGAAGGAGCGCGAGGCGGTCGCAGGTATTTATACTG
GCCGTAATACTACATACTATGCCGACTCCGTGAAGGACCGATTCACCATCTCCCAAGACAACGCCAAGAACACTGTGTTT
CTGCAAATGAACAGCCTGAAACCTGAGGACACTGCCATGTACTACTGTGCGTCAAAATACTGTGCGGTGGTAGCTGAATT
CGGGGGTCCTCGACTCGTTCGTTACTGGGGCCAGGGGACCCAGGTCACCGTCTCCTCA (AS60676 sdAb nucleic acid sequence)
SEQ ID NO: 305
CAGGTGCAGCTGGTGGAGTCTGGGGGAGGGTCGGTGCAGGCTGGAGGGTCTCTGAGACTCTCCTGCGCAGCCTCTGGATA
CACCGTCAGTAGCGGCTGCATGGGCTGGTTCCGCCAGGCTCCAGGGAAGGAGCGCGAGCGGGTCGCACAGATTGGTCGTG
ATGCTACCACGACCTACGCAGACTCCGTGAAGGGCCGATTCACCATCGCCAGAGACGACGCCGAGAACACTCTGTATCTG
CAAATGAACAGCCTGAAACCTGAAGACACTGCCATGTACAGCTGTACGGCCTATTGGGGTGTATACTGTTTATCTCCAGG
ACGCTACTGGGGCCAGGGGACCCAGGTCACCGTCTCCTCA (AS60678 sdAb nucleic acid sequence)
SEQ ID NO: 306
CAGGTGCACCTGGTGGAGTCTGGGGGAGGCTCGGTGCAGGCTGGAGGGTCTCTGAGACTCTCCTGTGCAGTCTCTGGATA
CACCTCCAGTCGCGGTTGCATGAGCTGGTTCCGCCAGGCTCCAGGGAAGGAGCGCGAGAGGGTCGCATACATTAATATGC
GTGTCCTAACCACAATCTATGCCGCCTCCGTGAAGGACCGATTCGCCATCTCCAGAGACAACGCCAAGAACACGGTGGAT
CTGCAAATGAACAACCTGAAACCTGAGGACACTGCCATGTACTACTGCGCGGCGGGGTACAATGGACAATGGTGCGAACA
TGCTAGTGACGTTACTGCCTGGGGTCAGGGGACCCAGGTCACCGTCTCCTCA (AS60679 sdAb nucleic acid sequence)
SEQ ID NO: 307
CAGGTGCACCTGATGGAGTCTGGGGGAGGCTCGGTGCAGGCTGGAGGGTCTCTGAGACTCTCCTGTGCACGCTCTGGAGT
CACCTATTGTAGGTTGACCATGAGGTGGTACCGCCAGGCTCCAGGGAGCGAGCGCGAGTTCGTCTCCGCTATTTATAGTG
ATGGTAGCACAGCCTACGCAGACTCCGTGAAGGGTCGATTCACCATGTCCCAAGACGACGCCAAGAACACGGTGTATCTG
CAAATGAACAGCGTGAAACCTGAGGACACGGCCATGTATTATTGTAAATTGAATTGTGCGTCCGGCTTGACTGCCTGGGG
CCAGGGGACCCAGGTCACCGTCTCCTCA (AS81326 sdAb nucleic acid sequence)
SEQ ID NO: 308
GAGGTGCAGCTGGTGGAGTCTGGGGGAGGCTCGGTGCAGGCTGGAGGGTCTCTGACACTCTCCTGTGCAGCCTCCGAGAG
TAGGGATTGTATGGCCTGGTTCCGCCAGGCTCCAGGGAAGGCGCGCGAGGGGGTCGCATCTATTTATGCTCCGGATGGTA
GCACAACCTATGCCGACACCGTGAAGGGCCGATTCACCATCTCCCAAGCAACGCCAAGAACACGCTGTATCTGCAAATG
AACAGCCTGCAACCTGAGGACGCTGCCATGTACCACTGTGCGATCGGGGGCTGTCACGCAATACTTGTGGTTACCTCAG
AGGCGGATACTTTGCTTACTTTGGCCGGGGGACCCAGGTCACCGTCTCCTCA (AS81187 sdAb nucleic acid sequence)
SEQ ID NO: 309
CAGGTGAGGTTGGTGGAGTCTGGGGGCGGCTCGGTGCAGGCTGGAGGGTCTCTGAGACTCTCCTGTGCAGCCTCTGGATA
CACCTACAGCAGCTACAGTAGCAACTGCCTGGGCTGGTTCCGCCAGGCTCCAGGGAAGGAGCGCGAGGCAGTCGCACGTA
TCTATCCTAACAGTGGTAGCACATACTATGCCGACTCCGTGAAGGGCCGCTTCACCATCTCCCAAGACAACGCCAAGAAC
ACGGTGTATCTACAAATGAACAGCCTGAAACCTGAGGACACTGCCATGTACTACTGTGCGGTAGCAGTGGGAGTCGGTGA
TAATTGGTGTGCGTCAGGGGCCGCATACTTTGGTTACTGGGGCCAGGGGACCCAGGTCACCGTCTCCTCA (AS80533 sdAb nucleic acid sequence)
SEQ ID NO: 310
CAGGTGCACCTGGTGGAGTCTGGGGGAGGCTCGGTGCAGACTGGAGGGTCTCTAAGACTCTCCTGTACAGCCTCTGGACT
CAGCTTCAGTACCTACACGGTGGCCTGGTTCCGCCAGGCTCCAGGAAAGGAGCGCGAGGGGGTCGCGGCTATTCCATATA
CTAGTCAACACATGGTCTATACCGACTCCGTGAAGGGCCGATTCACCATCTCCCGAGACAACACAAAGAACATGGTGTAT
CTGCAAATGAACAGCCTGAAACCGGAGGACACCGCCATGTACTACTGTGCGACAGATCGGCGCCCTGGAACGAGTATGTT
GGCTATAAATGGGTATAACCGCTGGGGCCAGGGGACCCAGGTCACCGTCTCCTCA (AS80444 sdAb nucleic acid sequence)
SEQ ID NO: 311
GAGGTGCAGCTGGCGGAGTCTGGGGGAGGCTCGGTGCAGGCTGGAGGGTCTCTGAGACTCTCCTGTGCAGCCTCTGGATT
CACCCTTCAGTCGCAACACGATGGGCTGGTTCCGCCAGGCTCCAGGGAAGGAGCGCGAGGGGGTCGCGGCTATTCCATATA
CTAGTACTGGCATAGTCTATTCCGACTCCGTGGGCGGCCGATTCACCATCTCCCGAGACAACACAAAGAACATGGTGTAT
CTGCAAATGAACAACCTGGAACCGGAGGACACTGCCATGTACTACTGTGCGACAGATCGGCGCCCTGGAACGACTATGTT
GGCGGTAAATGGGTATAACCACTGGGGCCAGGGGACCCAGGTCACCGTCTCCTCA (AS81487 sdAb nucleic acid sequence)

SEQ ID NO: 312

```
CAGGTGAGGTTGGTGGAGTCTGGGGGAGGCTCGGTGCAGGCTGGAGGGTCTCTGAGAGTCTCCTGTTTAGTCTCTAAACT
CACCGCATGGCGCAGCTGCGTGGGCTGGTTCCGCCAGGCTCCAGGGAAGGAGCGCGAGGGGGTCGCAGCTATATATTCTG
GTACTGGTAGTACATACTATGCCGACTCCGTGAAGGGCCGATTCACCATCGCCCAAGACTACGCCAAGAACATGGTGTAC
TTGCAAATGAACAGCCTGAAACCTGAAGACACTGCCATGTACTACTGTGCGGGCACGTCGATACGCAGCAGTTGTGGCTT
AGTGCGCGATGAATACGCCTACTGGGGCCAGGGGACCCAGGTCACCGTCTCCTCA
```

(SS1 scFv amino acid sequence; CDRs are underlined)

SEQ ID NO: 313

QVQLQQSGPELEKPGASVKISCKASGYSFTGYTMNWVKQSHGKSLEWIGLITPYNGASSYNQKFRGKATLTVDKSSSTAY
MDLLSLTSEDSAVYFCARGGYDGRGFDYWGQGTTVTVSSGGGGSGGGGSGGGGSDIELTQSPAIMSASPGEKVTMTCSAS
SSVSYMHWYQQKSGTSPKRWIYDTSKLASGVPGRFSGSGSGNSYSLTISSVEAEDDATYYCQQWSGYPLTFGAGTKLEI (M5 scFv amino acid sequence; CDRs are underlined)

SEQ ID NO: 314

QVQLVQSGAEVEKPGASVKVSCKASGYTFTDYYMHWVRQAPGQGLEWMGWINPNSGGTNYAQKFQGRVTMTRDTSISTAY
MELSRLRSDDTAVYYCASGWDFDYWGQGTLVTVSSGGGGSGGGGSGGGGSGGGGSDIVMTQSPSSLSASVGDRVTITCRA
SQSIRYYLSWYQQKPGKAPKLLIYTASILQNGVPSRFSGSGSGTDFTLTISSLQPEDFATYYCLQTYTTPDFGPGTKVEI
K (Human mesothelin amino acid sequence)

SEQ ID NO: 315

MALPTARPLLGSCGTPALGSLLFLLFSLGWVQPSRTLAGETGQEAAPLDGVLANPPNISSLSPRQLLGFPCAEVSGLSTE
RVRELAVALAQKNVKLSTEQLRCLAHRLSEPPEDLDALPLDLLLFLNPDAFSGPQACTRFFSRITKANVDLLPRGAPERQ
RLLPAALACWGVRGSLLSEADVRALGGLACDLPGRFVAESAEVLLPRLVSCPGPLDQDQQEAARAALQGGGPPYGPPSTW
SVSTMDALRGLLPVLGQPIIRSIPQGIVAAWRQRSSRDPSWRQPERTILRPRFRREVEKTACPSGKKAREIDESLIFYKK
WELEACVDAALLATQMDRVNAIPFTYEQLDVLKHKLDELYPQGYPESVIQHLGYLFLKMSPEDIRKWNVTSLETLKALLE
VNKGHEMSPQVATLIDRFVKGRGQLDKDTLDTLTAFYPGYLCSLSPEELSSVPPSSIWAVRPQDLDTCDPRQLDVLYPKA
RLAFQNMNGSEYFVKIQSFLGGAPTEDLKALSQQNVSMDLATFMKLRTDAVLPLTVAEVQKLLGPHVEGLKAEERHRPVR
DWILRQRQDDLDTLGLGLQGGIPNGYLVLDLSMQEALSGTPCLLGPGPVLTVLALLLASTLA (Cynomolgus mesothelin amino acid sequence)

SEQ ID NO: 316

MALPMARPLSGSCGTPALGSLLFLLFSLGWVQPSRVLAGETRQVRSPLGKPGRVFSLSPRQLLGFTCVEVSGLSTELVQE
LAVALGQKNVKLSAEQLRCLAHQLSEPPEDLDALPLDLLLFLNPDAFSGPQACTHFFSRVAKANVDLLPRGAPERQRLLP
AALTCWGVRGSLLSEADVRALGGLACDLPGRFVAESAEVVLPRLVRCLGPLDQDQQEAARAALQRGGGPPYGPPSTWSIST
LDDLQSLLPVLGQPVIHSIPQGILAAWRQRSSRDPSWQQPEQTVLRPRFRRDVERTTCPPEKEVHEIDESLIFYKKRELE
ACVDPALLAAQMDRVDAIPFTYEQDVLKHKLDELYPQGYPESVIRHLGHLFLKMSPEDIRKWNVTSLETLKALLKVSKG
HEMSAQWPVPQVATLIDRVVVGRGQLDKDTVDTLTAFCPGCLCSLSPERLSSVPPSVIGAVRPQDLDTCGPRQLDVLYPK
ARLAFQNMSGSEYFVKIRPFLGGAPTEDVKALSQQNVSMDLATFMKLRREAVLPLTVAEVQKLLGPHVEGLKVEEQHSPV
RDWILKQRQDDLDTLGLGLQGGIPNGYLILDLSVREALSGTPCLLGPGPVLTVLALLLASTLA (Megakaryocyte potentiating factor amino acid sequence)

SEQ ID NO: 317

MALPTARPLLGSCGTPALGSLLFLLFSLGWVQPSRTLAGETGQEAAPLDGVLANPPNISSLSPRQLLGFPCAEVSGLSTE
RVRELAVALAQKNVKLSTEQLRCLAHRLSEPPEDLDALPLDLLLFLNPDAFSGPQACTRFFSRITKANVDLLPRGAPERQ
RLLPAALACWGVRGSLLSEADVRALGGLACDLPGRFVAESAEVLLPRLVSCPGPLDQDQQEAARAALQGGGPPYGPPSTW
SVSTMDALRGLLPVLGQPIIRSIPQGIVAAWRQRSSRDPSWRQPERTILRPRFRR (Mature mesothein amino acid sequence)

SEQ ID NO: 318

EVEKTACPSGKKAREIDESLIFYKKWELEACVDAALLATQMDRVNAIPFTYEQLDVLKHKLDELYPQGYPESVIQHLGYL
FLKMSPEDIRKWNVTSLETLKALLEVNKGHEMSPQVATLIDRFVKGRGQLDKDTLDTLTAFYPGYLCSLSPEELSSVPPS
SIWAVRPQDLDTCDPRQLDVLYPKARLAFQNMNGSEYFVKIQSFLGGAPTEDLKALSQQNVSMDLATFMKLRTDAVLPLT
VAEVQKLLGPHVEGLKAEERHRPVRDWILRQRQDDLDTLGLGLQGGIPNGYLVLDLSMQEALSGTPCLLGPGPVLIVLAL
LLASTLA (FSHβ 33-53 amino acid sequence)

SEQ ID NO: 319

YTRDLVYKDPARPKIQKTCTF (FSHβ 51-65 amino acid sequence)

SEQ ID NO: 320

CTFKELVYETVRVPGC (FSHβ 81-95 amino acid sequence)

SEQ ID NO: 321

QCHCGKCDSDSTDCT (FSHβ 87-94 + FSHβ 25-42 amino acid sequence)

SEQ ID NO: 322

CDSDSTDCILQCMGCCFSRAYPTPLR (FSHβ 87-94 + FSHβ 25-42 + FSHβ 27-45 amino acid sequence)

SEQ ID NO: 323

CDSDSTDCILQCMGCCFSRAYPTPLRWCAGYCYCYTRDVKDPARP (Anti-FSHR peptide 33-53 amino acid sequence)

SEQ ID NO: 324

YTRDLVYKDPARPKIQKTC (Anti-FSHR peptide 51-65 amino acid sequence)
SEQ ID NO: 325
KTCTFKELVYETVRV (Anti-FSHR peptide 81-95 amino acid sequence)
SEQ ID NO: 326
GSQCHCGKCDSDSTDCTAS (anti-FSHR antagonist A amino acid sequence)
SEQ ID NO: 327
GSCDSDSTDCILQCMGCCFSRAYPTPLRAS (anti-FSHR antagonist B amino acid sequence)
SEQ ID NO: 328
GSRLPTPYARSFCCGMCQLICDTSDSDCAS (anti-FSHR agonist A amino acid sequence)
SEQ ID NO: 329
GSCDSDSTDCILQCMGCCFSRAYPTPLRWCAGYCYCYTRDLVKDPARPAS (anti-FSHR agonist B amino acid sequence)
SEQ ID NO: 330
PRAPDKVLDRTYCYCYGACWRLPTPYARSFCCGMCQLICDTSDSDC (anti-FSHR peptide alpha + beta chain amino acid sequence)
SEQ ID NO: 331
GSNSCELINITIAIEKEECRFCISINTTWCAGYCYTRDLVYKDPARPKIQKTCTFKELVYETVRVPGCAHHADSLYTYPV
ATQCHCGKCDSDSTDCTVRGLGPSYCSFGEMKEAPDVQDCPECTLQENPFFSQPGAPILQCMGCCFSRAYP TPLRSKKTM
LVQKNVTSESTCCVAKSYNRVTVMGGFKVENHTACHCSTCYYHKSAS (Fc fusion FSHβ 33-53 amino acid sequence)
SEQ ID NO: 332
YTRDLVYKDPARPKIQKTCTFEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKGQPREPQVYTLPPS
RDELTKNQVSLTCLVKGFYPSDIAVEWESNGQPENNYKTTPPVLDSDGSFFLYSKLTVDKSRWQQGNVFSCSVMHEALHN
HYTQKSLSLSPGK (Fc fusion FSHβ 33-53 nucleic acid sequence)
SEQ ID NO: 333
TACACCCGGGACCTGGTGTATAAGGATCCCGCCAGACCTAAGATCCAGAAGACCTGCACATTCGAGCCCAAGTCCTGTGA
TAAGACCCACACATGCCCCCCTTGTCCTGCTCCAGAGCTGCTGGGCGGCCCTAGCGTGTTCCTGTTTCCACCCAAGCCTA
AGGACACCCTGATGATCTCTCGGACCCCAGAGGTGACATGCGTGGTGGTGGACGTGAGCCACGAGGATCCCGAGGTGAAG
TTTAACTGGTATGTGGATGGCGTGGAGGTGCACAATGCCAAGACCAAGCCCAGAGAGGAGCAGTACAACTCCACCTATAG
GGTGGTGTCTGTGCTGACAGTGCTGCACCAGGACTGGCTCAACGGCAAGGAGTATAAGTGCAAGGTGTCCAATAAGGCCC
TGCCCGCCCCTATCGAGAAGACCATCTCTAAGGCCAAGGGCCAGCCTCGGGAGCCACAGGTGTACACACTGCCTCCATCC
AGAGACGAGCTGACCAAGAACCAGGTGTCTCTGACATGTCTGGTCAAGGGCTTCTATCCCTCTGATATCGCCGTGGAGTG
GGAGAGCAATGGCCAGCCTGAGAACAATTACAAGACCACACCCCCTGTGCTGGACTCCGATGGCTCTTTCTTTCTGTATA
GCAAGCTGACCGTGGATAAGTCCCGGTGGCAGCAGGGCAACGTGTTCAGCTGTTCCGTGATGCACGAGGCACTGCACAAC
CATTACACCCAGAAGTCACTGTCACTGTCCCCAGGCAAG (Linker amino acid sequence)
SEQ ID NO: 334
GGGGS (Linker amino acid sequence)
SEQ ID NO: 335
GGGGSGGGGS (Linker amino acid sequence)
SEQ ID NO: 336
GGGGSGGGGSGGGGS (Linker amino acid sequence)
SEQ ID NO: 337
GGGGSGGGGSGGGGSGGGGS (Linker amino acid sequence)
SEQ ID NO: 338
GGGGSGGGGSGGGGSGGGGSGGGGS (EF1α promoter nucleic acid sequence)
SEQ ID NO: 339
GAGTAATTCATACAAAAGGACTCGCCCCTGCCTTGGGGAATCCCAGGGACCGTCGTTAAACTCCCACTAACGTAGAACCC
AGAGATCGCTGCGTTCCCGCCCCCTCACCCGCCCGCTCTCGTCATCACTGAGGTGGAGAAGAGCATGCGTGAGGCTCCGG
TGCCCGTCAGTGGGCAGAGCGCACATCGCCCACAGTCCCCGAGAAGTTGGGGGGAGGGGTCGGCAATTGAACCGGTGCCT
AGAGAAGGTGGCGCGGGGTAAACTGGGAAAGTGATGTCGTGTACTGGCTCCGCCTTTTTCCCGAGGGTGGGGGAGAACCG
TATATAAGTGCAGTAGTCGCCGTGAACGTTCTTTTTCGCAACGGGTTTGCCGCCAGAACACAGGTAAGTGCCGTGTGTGG
TTCCCGCGGGCCTGGCCTCTTTACGGGTTATGGCCCTTGCGTGCCTTGAATTACTTCCACGCCCCTGGCTGCAGTACGTG
ATTCTTGATCCCGAGCTTCGGGTTGGAAGTGGGTGGAGAGTTCGAGGCCTTGCGCTTAAGGAGCCCCTTCGCCTCGTGC
TTGAGTTGAGGCCTGGCTTGGGCGCTGGGGCCGCCGCGTGCGAATCTGGTGGCACCTTCGCGCCTGTCTCGCTGCTTTCG -continued
```
ATAAGTCTCTAGCCATTTAAAATTTTTGATGACCTGCTGCGACGCTTTTTTTCTGGCAAGATAGTCTTGTAAATGCGGGC
CAAGATCTGCACACTGGTATTTCGGTTTTTGGGGCCGCGGGCGGCGACGGGGCCCGTGCGTCCCAGCGCACATGTTCGGC
GAGGCGGGGCCTGCGAGCGCGGCCACCGAGAATCGGACGGGGGTAGTCTCAAGCTGGCCGGCCTGCTCTGGTGCCTGGCC
TCGCGCCGCCGTGTATCGCCCCGCCCTGGGCGGCAAGGCTGGCCCGGTCGGCACCAGTTGCGTGAGCGGAAAGATGGCCG
CTTCCCGGCCCTGCTGCAGGGAGCTCAAAATGGAGGAGCGGCGGCGCTCGGGAGAGCGGCGGGTGAGTCACCCACACAAAG
GAAAAGGGCCTTTCCGTCCTCAGCCGTCGCTTCATGTGACTCCACGGAGTACCGGGCGCCGTCCAGGCACCTCGATTAGT
TCTCGAGCTTTTGGAGTACGTCGTCTTTAGGTTGGGGGGAGGGGTITTATGCGATGGAGTTTCCCCACACTGAGTGGGTG
GAGACTGAAGTTAGGCCAGCTTGGCACTTGATGTAATTCTCCTTGGAATTTGCCCTTTTTGAGTTTGGATCTTGGTTCAT
TCTCAAGCCTCAGACAGTGGTTCAAAGTTTTTTTCTTCCATTTCAGGTGTCGTGA
```

(CD8α signal peptide amino acid sequence)

SEQ ID NO: 340

MALPVTALLLPLALLLHAARP (CD8α hinge amino acid sequence)

SEQ ID NO: 341

TTTPAPRPPTPAPTIASQPLSLRPEACRPAAGGAVHIRGLDFACD (CD8α transmembrane domain amino acid sequence)

SEQ ID NO: 342

IYIWAPLAGTCGVLLLSLVITLYC (CD137 intracellular domain amino acid sequence)

SEQ ID NO: 343

KRGRKKLLYIFKQPFMRPVQTTQEEDGCSCRFPEEEEGGCEL (CD28 intracellular domain amino acid sequence)

SEQ ID NO: 344

RSKRSRLLHSDYMNMTPRRPGPTRKHYQPYAPPRDFAAYRS (CD3ζ intracellular domain amino acid sequence)

SEQ ID NO: 345

RVKFSRSADAPAYKQGQNQLYNELNLGRREEYDVLDKRRGRDPEMGGKPRRKNPQEGLY-
NELQKDKMAEAY SEI GMKGER
RRGKGHDGLYQGLSTATKDTYDALHMQALPPR (P2A element amino acid sequence)

SEQ ID NO: 346

GSGATNFSLLKQAGDVEENPGP (dnTGFβ RII amino acid sequence)

SEQ ID NO: 347

MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSS (FSHβ 33-53 + AD58-1-26VH3VL1 scFv tandem amino acid sequence)

SEQ ID NO: 348

YTRDLVYKDPARPKIQKTCTFGGGGSGGGGSGGGGSQVQLVQSGAEVKKPGASVKVSCKASGYTFTSYWMHWVKQAPGQG
LEWIGYINPSTGHTDYNQKFKDRATLTADTSTSTVYMELSSLRSEDTAVYYCARSNWAWFPYWGQGTLVTVSSGGGGSGG
GGSGGGGSDIVMTQSPDSLAVSLGERATINCKSSQSLLNSGNQKNYLTWYQQKPGQPPKLLIYWASTRESGVPDRESGSG
SGTDFTLTISSLQAEDVAVYYCQNDYSYPLTFGGGTKLEIK (FSHβ 33-53 + AS51489 scFv tandem amino acid sequence)

SEQ ID NO: 349

YTRDLVYKDPARPKIQKTCTFGGGGSGGGGSGGGGSEVQLVESGGGLVQPGGSLRLSCAASGENLYYYSIHWVRQAPGKG
LEWVAYISSSSSYTYYADSVKGRFTISADTSKNTAYLQMNSLRAEDTAVYYCARYPYYGMDYWGQGTLVTVSSGGGGSG
GGGSGGGGSDIQMTQSPSSLSASVGDRVTITCRASQSVSSAVAWYQQKPGKAPKLLIYSASSLYSGVPSRFSGSRSGTDF
TLTISSLQPEDFATYYCQQGFSYYPITFGQGTKVEIK (FSHβ 33-53 + AS92110 scFv tandem amino acid sequence)

SEQ ID NO: 350

YTRDLVYKDPARPKIQKTCTFGGGGSGGGGSGGGGSEVQLVESGGGLVQPGGSLRLSCAASGENIYYSSMHWVRQAPGKG
LEWVAYIYPYYSYTYYADSVKGRFTISADTSKNTAYLQMNSLRAEDTAVYYCARGYALDYWGQGTLVTVSSGGGGSGGGG
SGGGGSDIQMTQSPSSLSASVGDRVTITCRASQSVSSAVAWYQQKPGKAPKLLIYSASSLYSGVPSRFSGSRSGTDFTLT
ISSLQPEDFATYYCQQASSGYHYLITFGQGTKVEIK (FSHβ 33-53 + AS91156 scFv tandem amino acid sequence)

SEQ ID NO: 351

YTRDLVYKDPARPKIQKTCTFGGGGSGGGGSGGGGSEVQLVESGGGLVQPGGSLRLSCAASGENIYSSSIHWVRQAPGKG
LEWVASISSYSSYTSYADSVKGRFTISADTSKNTAYLQMNSLRAEDTAVYYCARYYAMDYWGQGTLVTVSSGGGGSGGGG
SGGGGSDIQMTQSPSSLSASVGDRVTITCRASQSVSSAVAWYQQKPGKAPKLLIYSASSLYSGVPSRFSGSRSGTDFTLT
ISSLQPEDFATYYCQQGPYYHPITFGQGTKVEIK (FSHβ 33-53 + AS91189 scFv tandem amino acid sequence)

SEQ ID NO: 352

YTRDLVYKDPARPKIQKTCTFGGGGSGGGGSGGGGSEVQLVESGGGLVQPGGSLRLSCAASGFNLSYSSIHWVRQAPGKG
LEWVASIYSYSGSTYYADSVKGRFTISADTSKNTAYLQMNSLRAEDTAVYYCARYWGMDYWGQGTLVTVSSGGGGSGGGG
SGGGGSDIQMTQSPSSLSASVGDRVTITCRASQSVSSAVAWYQQKPGKAPKLLIYSASSLYSGVPSRFSGSRSGTDFTLT
ISSLQPEDFATYYCQQYYWYYPITFGQGTKVEIK

-continued (FSHβ 33-53 + AS51674 scFv tandem amino acid sequence)
SEQ ID NO: 353
YTRDLVYKDPARPKIQKTCTFGGGGSGGGGSGGGGSEVQLVESGGGLVQPGGSLRLSCAASGENLYSYYMHWVRQAPGKG
LEWVASIYSYSSYTSYADSVKGRFTISADTSKNTAYLQMNSLRAEDTAVYYCARPFGWGYAGMDYWGQGTLVTVSSGGGG
SGGGGSGGGGSDIQMTQSPSSLSASVGDRVTITCRASQSVSSAVAWYQQKPGKAPKLLIYSASSLYSGVPSRFSGSRSGT
DFTLTISSLQPEDFATYYCQQGYAPITFGQGTKVEIK (FSHβ 33-53 + AS65233 sdAb tandem amino acid sequence)

SEQ ID NO: 354

YTRDLVYKDPARPKIQKTCTFGGGGSGGGGSGGGGSQVHLVESGGGSVQAGGSLRLSCAASEFTYSMGWFRQAPGKEREG
VAHIYTRGGTTVYADSVKGRFVLSRYNAKSIMYLQMNSVKLEDTAMYYCAARTIFEGSWSSPSSFDFWGQGTQVTVSS (FSHβ 33-53 + AS60685 sdAb tandem amino acid sequence)

SEQ ID NO: 355

YTRDLVYKDPARPKIQKTCTFGGGGSGGGGSGGGGSQVQLVESGGGSVQAGGSLRLSCAASGNVYNNMCMGWFRQAPGKE
REGVASMYVGGGYTYYDDSVKGRFTISRDNAKNTLYLQMNSLKPEDTAMYYCAAISIALTREFCAPIVSRYNYWGQGTQV
TVSS (FSHβ 33-53 + AS60702 sdAb tandem amino acid sequence)

SEQ ID NO: 356

YTRDLVYKDPARPKIQKTCTFGGGGSGGGGSGGGGSQVKLVESGGGSVQAGGSLRLSCAASGNVYNNMCMGWFRQAPGKE
REGVASI YVGGGYTNYADSVRGRFTISQDNAKNTLYLQMNSLKPEDTAMYYCAAITVALTRAFCAPIPSRYTNWGQGTQV
TVSS (FSHβ 33-53 + AS60676 sdAb tandem amino acid sequence)

SEQ ID NO: 357

YTRDLVYKDPARPKIQKTCTFGGGGSGGGGSGGGGSQVQLVESGGGSVQAGGSLRLSCAASGYTVSSGCMGWFRQAPGKE
RERVAQIGRDATTTYADSVKGRFTIARDDAENTLYLQMNSLKPEDTAMYSCTAYWGVYCLSPGRYWGQGTQVTVSS (AD58126VH3VL1 CAR amino acid sequence)

SEQ ID NO: 358

MALPVTALLLPLALLLHAARPQVQLVQSGAEVKKPGASVKVSCKASGYTFTSYWMHWVKQAPGQGLEWIGYINPSTGHTD
YNQKFKDRATLTADTSTSTVYMELSSLRSEDTAVYYCARSNWAWFPYWGQGTLVTVSSGGGGSGGGGSGGGGSDIVMTQS
PDSLAVSLGERATINCKSSQSLLNSGNQKNYLTWYQQKPGQPPKLLIYWASTRESGVPDRFSGSGSGTDETLTISSLQAE
DVAVYYCQNDYSYPLTFGGGTKLEIKTTTPAPRPPTPAPTIASQPLSLRPEACRPAAGGAVHTRGLDFACDIYIWAPLAG
TCGVLLLSLVITLYCKRGRKKLLYIFKQPFMRPVQTTQEEDGCSCRFPEEEEGGCELRVKFSRSADAPAYKQGQNQLYNE
LNLGRREEYDVLDKRRGRDPEMGGKPRRKNPQEGLYNELQKDKMAEAYSEIGMKGERRRGKGHDGLYQGLSTATKDTYDA
LHMQALPPR (AS51489 CAR amino acid sequence)

SEQ ID NO: 359

MALPVTALLLPLALLLHAARPEVQLVESGGGLVQPGGSLRLSCAASGENLYYYSIHWVRQAPGKGLEWVAYISSSSSYTY
YADSVKGRFTISADTSKNTAYLQMNSLRAEDTAVYYCARYYPYYGMDYWGQGTLVTVSSGGGGSGGGGSGGGGSDIQMTQ
SPSSLSASVGDRVTITCRASQSVSSAVAWYQQKPGKAPKLLIYSASSLYSGVPSRFSGSRSGTDFTLTISSLQPEDFATY
YCQQGFSYYPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPR (AS92110 CAR amino acid sequence)

SEQ ID NO: 360

MALPVTALLLPLALLLHAARPEVQLVESGGGLVQPGGSLRLSCAASGENIYYSSMHWVRQAPGKGLEWVAYIYPYYSYTY
YADSVKGRFTISADTSKNTAYLQMNSLRAEDTAVYYCARGYALDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QASSGYHYLITFGQGTKVEIKTTTPAPRPPTPAPTIASQPLSLRPEACRPAAGGAVHTRGLDFACDIYIWAPLAGTCGVL
LLSLVITLYCKRGRKKLLYIFKQPFMRPVQTTQEEDGCSCRFPEEEEGGCELRVKFSRSADAPAYKQGQNQLYNELNLGR
REEYDVLDKRRGRDPEMGGKPRRKNPQEGLYNELQKDKMAEAYSEIGMKGERRRGKGHDGLYQGLSTATKDTYDALHMQA
LPPR (AS91156 CAR amino acid sequence)

SEQ ID NO: 361

MALPVTALLLPLALLLHAARPEVQLVESGGGLVQPGGSLRLSCAASGENIYSSSIHWVRQAPGKGLEWVASISSYSSYTS
YADSVKGRFTISADTSKNTAYLQMNSLRAEDTAVYYCARYYAMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QGPYYHPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PR (AS91189 CAR amino acid sequence)

SEQ ID NO: 362

MALPVTALLLPLALLLHAARPEVQLVESGGGLVQPGGSLRLSCAASGFNLSYSSIHWVRQAPGKGLEWVASIYSYSGSTY
YADSVKGRFTISADTSKNTAYLQMNSLRAEDTAVYYCARYWGMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QYYWYYPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PR

-continued (AS51674 CAR amino acid sequence)
SEQ ID NO: 363
MALPVTALLLPLALLLHAARPEVQLVESGGGLVQPGGSLRLSCAASGENLYSYYMHWVRQAPGKGLEWVASIYSYSSYTS
YADSVKGRFTISADTSKNTAYLQMNSLRAEDTAVYYCARPFGWGYAGMDYWQGTLVTVSSGGGGSGGGGSGGGGSDIQM
TQSPSSLSASVGDRVTITCRASQSVSSAVAWYQQKPGKAPKLLIYSASSLYSGVPSRFSGSRSGTDFTLTISSLQPEDFA
TYYCQQGYAPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPR (AS65233 CAR amino acid sequence)
SEQ ID NO: 364
MALPVTALLLPLALLLHAARPQVHLVESGGGSVQAGGSLRLSCAASEFTYSMGWFRQAPGKEREGVAHIYTRGGTTVYAD
SVKGRFVLSRYNAKSIMYLQMNSVKLEDTAMYYCAARTIFEGSWSSPSSFDFWGQGTQVTVSSTTTPAPRPPTPAPTIAS
QPLSLRPEACRPAAGGAVHTRGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMGGKPRRKNPQEGLYNELQKDK
MAEAYSEIGMKGERRRGKGHDGLYQGLSTATKDTYDALHMQALPPR (AS60685 CAR amino acid sequence)
SEQ ID NO: 365
MALPVTALLLPLALLLHAARPQVQLVESGGGSVQAGGSLRLSCAASGNVYNNMCMGWFRQAPGKEREGVASMYVGGGYTY
YDDSVKGRFTISRDNAKNTLYLQMNSLKPEDTAMYYCAAISIALTREFCAPIVSRYNYWGQGTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPR (AS60702 CAR amino acid sequence)
SEQ ID NO: 366
MALPVTALLLPLALLLHAARPQVKLVESGGGSVQAGGSLRLSCAASGNVYNNMCMGWFRQAPGKEREGVASIYVGGGYTN
YADSVRGRFTISQDNAKNTLYLQMNSLKPEDTAMYYCAAITVALTRAFCAPIPSRYTNWGQGTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPR (AS60676 CAR amino acid sequence)
SEQ ID NO: 367
MALPVTALLLPLALLLHAARPQVQLVESGGGSVQAGGSLRLSCAASGYTVSSGCMGWFRQAPGKERERVAQIGRDATTTY
ADSVKGRFTIARDDAENTLYLQMNSLKPEDTAMYSCTAYWGVYCLSPGRYWQGTQVTVSSTTTPAPRPPTPAPTIASQP
LSLRPEACRPAAGGAVHTRGLDFACDIYIWAPLAGTCGVLLLSLVITLYCKRGRKKLLYIFKQPFMRPVQTTQEEDGCSC
RFPEEEEGGCELRVKFSRSADAPAYKQGQNQLYNELNLGRREEYDVLDKRRGRDPEMGGKPRRKNPQEGLYNELQKDKMA
EAYSEIGMKGERRRGKGHDGLYQGLSTATKDTYDALHMQALPPR (SS1 CAR amino acid sequence)
SEQ ID NO: 368
MALPVTALLLPLALLLHAARPQVQLQQSGPELEKPGASVKISCKASGYSFTGYTMNWVKQSHGKSLEWIGLITPYNGASS
YNQKFRGKATLTVDKSSSTAYMDLLSLTSEDSAVYFCARGGYDGRGFDYWGQGTTVTVSSGGGGSGGGGSGGGGSDIELT
QSPAIMSASPGEKVTMTCSASSSVSYMHWYQQKSGTSPKRWIYDTSKLASGVPGRFSGSGSGNSYSLTISSVEAEDDATY
YCQQWSGYPLTFGAGTKLEITTTPAPRPPTPAPTIASQPLSLRPEACRPAAGGAVHTRGLDFACDIYIWAPLAGTCGVLL
LSLVITLYCKRGRKKLLYIFKQPFMRPVQTTQEEDGCSCRFPEEEEGGCELRVKFSRSADAPAYKQGQNQLYNELNLGRR
EEYDVLDKRRGRDPEMGGKPRRKNPQEGLYNELQKDKMAEAYSEIGMKGERRRGKGHDGLYQGLSTATKDTYDALHMQAL
PPR (M5 CAR amino acid sequence)
SEQ ID NO: 369
MALPVTALLLPLALLLHAARPQVQLVQSGAEVEKPGASVKVSCKASGYTFTDYYMHWVRQAPGQGLEWMGWINPNSGGTN
YAQKFQGRVTMTRDTSISTAYMELSRLRSDDTAVYYCASGWDGYLVTVSSGGGGSGGGGSGGGGSDIVM
TQSPSSLSASVGDRVTITCRASQSIRYYLSWYQQKPGKAPKLLIYTASILQNGVPSRFSGSGSGTDFTLTISSLQPEDFA
TYYCLQTYTTPDFGPGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPR (FSHβ 33-53 + AD58-1-26VH3VL1 tandem CAR amino acid sequence)
SEQ ID NO: 370
MALPVTALLLPLALLLHAARPYTRDLVYKDPARPKIQKTCTFGGGGSGGGGSGGGGSQVQLVQSGAEVKKPGASVKVSCK
ASGYTFTSYWMHWVKQAPGQGLEWIGYINPSTGHTDYNQKFKDRATLTADTSTSTVYMELSSLRSEDTAVYYCARSNWAW
FPYWGQGTLVTVSSGGGGSGGGGSGGGGSDIVMTQSPDSLAVSLGERATINCKSSQSLLNSGNQKNYLTWYQQKPGQPPK
LLIYWASTRESGVPDRFSGSGSGTDFTLTISSLQAEDVAVYYCQNDYSYPLTFGGGTKLEIKTTTPAPRPPTPAPTIASQ
PLSLRPEACRPAAGGAVHTRGLDFACDIYIWAPLAGTCGVLLLSLVITLYCKRGRKKLLYIFKQPFMRPVQTTQEEDGCS
CRFPEEEEGGCELRVKFSRSADAPAYKQGQNQLYNELNLGRREEYDVLDKRRGRDPEMGGKPRRKNPQEGLYNELQKDKM
AEAYSEIGMKGERRRGKGHDGLYQGLSTATKDTYDALHMQALPPR (FSHβ 33-53 + AS51489 tandem CAR amino acid sequence)
SEQ ID NO: 371
MALPVTALLLPLALLLHAARPYTRDLVYKDPARPKIQKTCTFGGGGSGGGGSGGGGSEVQLVESGGGLVQPGGSLRLSCA
ASGFNLYYYSIHWVRQAPGKGLEWVAYISSSSSYTYYADSVKGRFTISADTSKNTAYLQMNSLRAEDTAVYYCARYPYY
GMDYWGQGTLVTVSSGGGGSGGGGSGGGGSDIQMTQSPSSLSASVGDRVTITCRASQSVSSAVAWYQQKPGKAPKLLIYS -continued
ASSLYSGVPSRFSGSRSGTDFTLTISSLQPEDFATYYCQQGFSYYPITFGQGTKVEIKTTTPAPRPPTPAPTIASQPLSL
RPEACRPAAGGAVHTRGLDFACDIYIWAPLAGTCGVLLLSLVITLYCKRGRKKLLYIFKQPFMRPVQTTQEEDGCSCRFP
EEEEGGCELRVKFSRSADAPAYKQGQNQLYNELNLGRREEYDVLDKRRGRDPEMGGKPRRKNPQEGLYNELQKDKMAEAY
SEIGMKGERRRGKGHDGLYQGLSTATKDTYDALHMQALPPR (FSHβ 33-53 + AS92110 tandem CAR amino acid sequence)
SEQ ID NO: 372
MALPVTALLLPLALLLHAARPYTRDLVYKDPARPKIQKTCTFGGGGSGGGGSGGGGSEVQLVESGGGLVQPGGSLRLSCA
ASGFNIYYSSMHWVRQAPGKGLEWVAYIYPYYSYTYYADSVKGRFTISADTSKNTAYLQMNSLRAEDTAVYYCARGYALD
YWGQGTLVTVSSGGGGSGGGGSGGGGSDIQMTQSPSSLSASVGDRVTITCRASQSVSSAVAWYQQKPGKAPKLLIYSASS
LYSGVPSRFSGSRSGTDFTLTISSLQPEDFATYYCQQASSGYHYLITFGQGTKVEIKTTTPAPRPPTPAPTIASQPLSLR
PEACRPAAGGAVHTRGLDFACDIYIWAPLAGTCGVLLLSLVITLYCKRGRKKLLYIFKQPFMRPVQTTQEEDGCSCRFPE
EEEGGCELRVKFSRSADAPAYKQGQNQLYNELNLGRREEYDVLDKRRGRDPEMGGKPRRKNPQEGLYNELQKDKMAEAYS
EIGMKGERRRGKGHDGLYQGLSTATKDTYDALHMQALPPR (FSHβ 33-53 + AS91156 tandem CAR amino acid sequence)
SEQ ID NO: 373
MALPVTALLLPLALLLHAARPYTRDLVYKDPARPKIQKTCTFGGGGSGGGGSGGGGSEVQLVESGGGLVQPGGSLRLSCA
ASGFNIYSSSIHWVRQAPGKGLEWVASISSYSSYTSYADSVKGRFTISADTSKNTAYLQMNSLRAEDTAVYYCARYYAMD
YWGQGTLVTVSSGGGGSGGGGSGGGGSDIQMTQSPSSLSASVGDRVTITCRASQSVSSAVAWYQQKPGKAPKLLIYSASS
LYSGVPSRFSGSRSGTDFTLTISSLQPEDFATYYCQQGPYYHPITFGQGTKVEIKTTTPAPRPPTPAPTIASQPLSLRPE
ACRPAAGGAVHTRGLDFACDIYIWAPLAGTCGVLLLSLVITLYCKRGRKKLLYIFKQPFMRPVQTTQEEDGCSCRFPEEE
EGGCELRVKFSRSADAPAYKQGQNQLYNELNLGRREEYDVLDKRRGRDPEMGGKPRRKNPQEGLYNELQKDKMAEAYSEI
GMKGERRRGKGHDGLYQGLSTATKDTYDALHMQALPPR (FSHβ 33-53 + AS91189 tandem CAR amino acid sequence)
SEQ ID NO: 374
MALPVTALLLPLALLLHAARPYTRDLVYKDPARPKIQKTCTFGGGGSGGGGSGGGGSEVQLVESGGGLVQPGGSLRLSCA
ASGFNLSYSSIHWVRQAPGKGLEWVASIYSYSGSTYYADSVKGRFTISADTSKNTAYLQMNSLRAEDTAVYYCARYWGMD
YWGQGTLVTVSSGGGGSGGGGSGGGGSDIQMTQSPSSLSASVGDRVTITCRASQSVSSAVAWYQQKPGKAPKLLIYSASS
LYSGVPSRFSGSRSGTDFTLTISSLQPEDFATYYCQQYWYYPITFGQGTKVEIKTTTPAPRPPTPAPTIASQPLSLRPE
ACRPAAGGAVHTRGLDFACDIYIWAPLAGTCGVLLLSLVITLYCKRGRKKLLYIFKQPFMRPVQTTQEEDGCSCRFPEEE
EGGCELRVKFSRSADAPAYKQGQNQLYNELNLGRREEYDVLDKRRGRDPEMGGKPRRKNPQEGLYNELQKDKMAEAYSEI
GMKGERRRGKGHDGLYQGLSTATKDTYDALHMQALPPR (FSHβ 33-53 + AS51674 tandem CAR amino acid sequence)
SEQ ID NO: 375
MALPVTALLLPLALLLHAARPYTRDLVYKDPARPKIQKTCTFGGGSGGGGSGGGGSEVQLVESGGGLVQPGGSLRLSCA
ASGFNLYSYYMHWVRQAPGKGLEWVASIYSYSSYTYADSVKGRFTISADTSKNTAYLQMNSLRAEDTAVYYCARPFGWG
YAGMDYWGQGTLVTVSSGGGGSGGGGSGGGGSDIQMTQSPSSLSASVGDRVTITCRASQSVSSAVAWYQQKPGKAPKLLI
YSASSLYSGVPSRFSGSRSGTDFTLTISSLQPEDFATYYCQQGYAPITFGQGTKVEIKTTTPAPRPPTPAPTIASQPLSL
RPEACRPAAGGAVHTRGLDFACDIYIWAPLAGTCGVLLLSLVITLYCKRGRKKLLYIFKQPFMRPVQTTQEEDGCSCRFP
EEEEGGCELRVKFSRSADAPAYKQGQNQLYNELNLGRREEYDVLDKRRGRDPEMGGKPRRKNPQEGLYNELQKDKMAEAY
SEIGMKGERRRGKGHDGLYQGLSTATKDTYDALHMQALPPR (FSHβ 33-53 + AS65233 tandem CAR amino acid sequence)
SEQ ID NO: 376
MALPVTALLLPLALLLHAARPYTRDLVYKDPARPKIQKTCTFGGGGSGGGGSGGGGSQVHLVESGGGSVQAGGSLRLSCA
ASEFTYSMGWFRQAPGKEREGVAHIYTRGGTTVYADSVKGRFVLSRYNAKSIMYLQMNSVKLEDTAMYYCAARTIFEGSW
SSPSSFDFWGQGTQVTVSSTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PR (FSHβ 33-53 + AS60685 tandem CAR amino acid sequence)
SEQ ID NO: 377
MALPVTALLLPLALLLHAARPYTRDLVYKDPARPKIQKTCTFGGGGSGGGGSGGGGSQVQLVESGGGSVQAGGSLRLSCA
ASGNVYNNMCMGWFRQAPGKEREGVASMYVGGGYTYYDDSVKGRFTISRDNAKTAMYYLQMNSLKPEDTAMYYCAAISIAL
TREFCAPIVSRYNYWGQGTQVTVSSTTTPAPRPPTPAPTIASQPLSLRPEACRPAAGGAVHTRGLDFACDIYIWAPLAGT
CGVLLLSLVITLYCKRGRKKLLYIFKQPFMRPVQTTQEEDGCSCRFPEEEEGGCELRVKFSRSADAPAYKQGQNQLYNEL
NLGRREEYDVLDKRRGRDPEMGGKPRRKNPQEGLYNELQKDKMAEAYSEIGMKGERRRGKGHDGLYQGLSTATKDTYDAL
HMQALPPR (FSHβ 33-53 + AS60702 tandem CAR amino acid sequence)
SEQ ID NO: 378
MALPVTALLLPLALLLHAARPYTRDLVYKDPARPKIQKTCTFGGGGSGGGGSGGGGSQVKLVESGGGSVQAGGSLRLSCA
ASGNVYNNMCMGWFRQAPGKEREGVASIYVGGGYTNYADSVRGRFTISQDNAKNTLYLQMNSLKPEDTAMYYCAAITVAL
TRAFCAPIPSRYTNWGQGTQVTVSSTTTPAPRPPTPAPTIASQPLSLRPEACRPAAGGAVHTRGLDFACDIYIWAPLAGT
CGVLLLSLVITLYCKRGRKKLLYIFKQPFMRPVQTTQEEDGCSCRFPEEEEGGCELRVKFSRSADAPAYKQGQNQLYNEL
NLGRREEYDVLDKRRGRDPEMGGKPRRKNPQEGLYNELQKDKMAEAYSEIGMKGERRRGKGHDGLYQGLSTATKDTYDAL
HMQALPPR (FSHβ 33-53 + AS60676 tandem CAR amino acid sequence)
SEQ ID NO: 379
MALPVTALLLPLALLLHAARPYTRDLVYKDPARPKIQKTCTFGGGGSGGGGSGGGGSQVQLVESGGGSVQAGGSLRLSCA
ASGYTVSSGCMGWFRQAPGKERERVAQIGRDATTTYADSVKGRFTIARDDAENTLYLQMNSLKPEDTAMYSCTAYWGVYC
LSPGRYWGQGTQVTVSSTTTPAPRPPTPAPTIASQPLSLRPEACRPAAGGAVHTRGLDFACDIYIWAPLAGTCGVLLLSL
VITLYCKRGRKKLLYIFKQPFMRPVQTTQEEDGCSCRFPEEEEGGCELRVKFSRSADAPAYKQGQNQLYNELNLGRREEY
DVLDKRRGRDPEMGGKPRRKNPQEGLYNELQKDKMAEAYSEIGMKGERRRGKGHDGLYQGLSTATKDTYDALHMQALPPR -continued (AD58126VH3VL1 + FSHβ 33-53 dual CAR amino acid sequence)
SEQ ID NO: 380
MALPVTALLLPLALLLHAARPQVQLVQSGAEVKKPGASVKVSCKASGYTFTSYWMHWVKQAPGQGLEWIGYINPSTGHTD
YNQKFKDRATLTADTSTSTVYMELSSLRSEDTAVYYCARSNWAWFPYWGMQGTLVTVSSGGGGSGGGGSGGGGSDIVMTQS
PDSLAVSLGERATINCKSSQSLLNSGNQKNYLTWYQQKPGQPPKLLIYWASTRESGVPDRFSGSGSGTDFTLTISSLQAE
DVAVYYCQNDYSYPLTFGGGTKLEIKTTTPAPRPPTPAPTIASQPLSLRPEACRPAAGGAVHTRGLDFACDIYIWAPLAG
TCGVLLLSLVITLYCKRGRKKLLYIFKQPFMRPVQTTQEEDGCSCRFPEEEEGGCELRVKFSRSADAPAYKQGQNQLYNE
LNLGRREEYDVLDKRRGRDPEMGGKPRRKNPQEGLYNELQKDKMAEAYSEIGMKGERRRGKGHDGLYQGLSTATKDTYDA
LHMQALPPRGSGATNFSLLKQAGDVEENPGPMALPVTALLLPLALLLHAARPYTRDLVYKDPARPKIQKTCTFTTTPAPR
PPTPAPTIASQPLSLRPEACRPAAGGAVHTRGLDFACDIYIWAPLAGTCGVLLLSLVITLYCRSKRSRLLHSDYMNMTPR
RPGPTRKHYQPYAPPRDFAAYRSRVKFSRSADAPAYKQGQNQLYNELNLGRREEYDVLDKRRGRDPEMGGKPRRKNPQEG
LYNELQKDKMAEAYSEIGMKGERRRGKGHDGLYQGLSTATKDTYDALHMQALPPR (AS51489 + FSHβ 33-53 dual CAR amino acid sequence)
SEQ ID NO: 381
MALPVTALLLPLALLLHAARPEVQLVESGGGLVQPGGSLRLSCAASGENLYYYSIHWVRQAPGKGLEWVAYISSSSSYTY
YADSVKGRFTISADTSKNTAYLQMNSLRAEDTAVYYCARYYPYYGMDYWGQGTLVTVSSGGGGSGGGGSGGGGSDIQMTQ
SPSSLSASVGDRVTITCRASQSVSSAVAWYQQKPGKAPKLLIYSASSLYSGVPSRFSGSRSGTDFTLTISSLQPEDFATY
YCQQGFSYYPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPRGSGATNFSLLKQAGDVEENPGPMALPVTALLLPLALLLHAARPYTRDLVYKDPARPKIQKTCTFTTTPAPRPPTP
APTIASQPLSLRPEACRPAAGGAVHTRGLDFACDIYIWAPLAGTCGVLLLSLVITLYCRSKRSRLLHSDYMNMTPRRPGP
TRKHYQPYAPPRDFAAYRSRVKFSRSADAPAYKQGQNQLYNELNLGRREEYDVLDKRRGRDPEMGGKPRRKNPQEGLYNE
LQKDKMAEAYSEIGMKGERRRGKGHDGLYQGLSTATKDTYDALHMQALPPR (AS92110 + FSHβ 33-53 dual CAR amino acid sequence)
SEQ ID NO: 382
MALPVTALLLPLALLLHAARPEVQLVESGGGLVQPGGSLRLSCAASGENIYYSSMHWVRQAPGKGLEWVAYTYPYYSYTY
YADSVKGRFTISADTSKNTAYLQMNSLRAEDTAVYYCARGYALDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QASSGYHYLITFGQGTKVEIKTTTPAPRPPTPAPTIASQPLSLRPEACRPAAGGAVHTRGLDFACDIYIWAPLAGTCGVL
LLSLVITLYCKRGRKKLLYIFKQPFMRPVQTTQEEDGCSCRFPEEEEGGCELRVKFSRSADAPAYKQGQNQLYNELNLGR
REEYDVLDKRRGRDPEMGGKPRRKNPQEGLYNELQKDKMAEAYSEIGMKGERRRGKGHDGLYQGLSTATKDTYDALHMQA
LPPRGSGATNFSLLKQAGDVEENPGPMALPVTALLLPLALLLHAARPYTRDLVYKDPARPKIQKTCTFTTTPAPRPPTPA
PTIASQPLSLRPEACRPAAGGAVHTRGLDFACDIYIWAPLAGTCGVLLLSLVITLYCRSKRSRLLHSDYMNMTPRRPGPT
RKHYQPYAPPRDFAAYRSRVKFSRSADAPAYKQGQNQLYNELNLGRREEYDVLDKRRGRDPEMGGKPRRKNPQEGLYNEL
QKDKMAEAYSEIGMKGERRRGKGHDGLYQGLSTATKDTYDALHMQALPPR (AS91156 + FSHβ 33-53 dual CAR amino acid sequence)
SEQ ID NO: 383
MALPVTALLLPLALLLHAARPEVQLVESGGGLVQPGGSLRLSCAASGENIYSSSIHWVRQAPGKGLEWVASISSYSSYTS
YADSVKGRFTISADTSKNTAYLQMNSLRAEDTAVYYCARYYAMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QGPYYHPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PRGSGATNFSLLKQAGDVEENPGPMALPVTALLLPLALLLHAARPYTRDLVYKDPARPKIQKTCTFTTTPAPRPPTPAPT
IASQPLSLRPEACRPAAGGAVHTRGLDFACDIYIWAPLAGTCGVLLLSLVITLYCRSKRSRLLHSDYMNMTPRRPGPTRK
HYQPYAPPRDFAAYRSRVKFSRSADAPAYKQGQNQLYNELNLGRREEYDVLDKRRGRDPEMGGKPRRKNPQEGLYNELQK
DKMAEAYSEIGMKGERRRGKGHDGLYQGLSTATKDTYDALHMQALPPR (AS91189 + FSHβ 33-53 dual CAR amino acid sequence)
SEQ ID NO: 384
MALPVTALLLPLALLLHAARPEVQLVESGGGLVQPGGSLRLSCAASGFNLSYSSIHWVRQAPGKGLEWVASIYSYSGSTY
YADSVKGRFTISADTSKNTAYLQMNSLRAEDTAVYYCARYWGMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QYYWYYPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PRGSGATNFSLLKQAGDVEENPGPMALPVTALLLPLALLLHAARPYTRDLVYKDPARPKIQKTCTFTTTPAPRPPTPAPT
IASQPLSLRPEACRPAAGGAVHTRGLDFACDIYIWAPLAGTCGVLLLSLVITLYCRSKRSRLLHSDYMNMTPRRPGPTRK
HYQPYAPPRDFAAYRSRVKFSRSADAPAYKQGQNQLYNELNLGRREEYDVLDKRRGRDPEMGGKPRRKNPQEGLYNELQK
DKMAEAYSEIGMKGERRRGKGHDGLYQGLSTATKDTYDALHMQALPPR (AS51674 + FSHβ 33-53 dual CAR amino acid sequence)
SEQ ID NO: 385
MALPVTALLLPLALLLHAARPEVQLVESGGGLVQPGGSLRLSCAASGENLYSYYMHWVRQAPGKGLEWVASIYSYSSYTS
YADSVKGRFTISADTSKNTAYLQMNSLRAEDTAVYYCARPFGWGYAGMDYWGQGTLVTVSSGGGGSGGGGSGGGGSDIQM
TQSPSSLSASVGDRVTITCRASQSVSSAVAWYQQKPGKAPKLLIYSASSLYSGVPSRFSGSRSGTDFTLTISSLQPEDFA
TYYCQQGYAPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPRGSGATNFSLLKQAGDVEENPGPMALPVTALLLPLALLLHAARPYTRDLVYKDPARPKIQKTCTFTTTPAPRPPTP
APTIASQPLSLRPEACRPAAGGAVHTRGLDFACDIYIWAPLAGTCGVLLLSLVITLYCRSKRSRLLHSDYMNMTPRRPGP
TRKHYQPYAPPRDFAAYRSRVKFSRSADAPAYKQGQNQLYNELNLGRREEYDVLDKRRGRDPEMGGKPRRKNPQEGLYNE
LQKDKMAEAYSEIGMKGERRRGKGHDGLYQGLSTATKDTYDALHMQALPPR -continued (AS65233 + FSHβ 33-53 dual CAR amino acid sequence)

SEQ ID NO: 386

MALPVTALLLPLALLLHAARPQVHLVESGGGSVQAGGSLRLSCAASEFTYSMGWFRQAPGKEREGVAHIYTRGGTTVYAD
SVKGRFVLSRYNAKSIMYLQMNSVKLEDTAMYYCAARTIFEGSWSSPSSFDFWGQGTQVTVSSTTTPAPRPPTPAPTIAS
QPLSLRPEACRPAAGGAVHTRGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMGGKPRRKNPQEGLYNELQKDK
MAEAYSEIGMKGERRRGKGHDGLYQGLSTATKDTYDALHMQALPPRGSGATNFSLLKQAGDVEENPGPMALPVTALLLPL
ALLLHAARPYTRDLVYKDPARPKIQKTCTFTTTPAPRPPTPAPTIASQPLSLRPEACRPAAGGAVHTRGLDFACDIYIWA
PLAGTCGVLLLSLVITLYCRSKRSRLLHSDYMNMTPRRPGPTRKHYQPYAPPRDFAAYRSRVKFSRSADAPAYKQGQNQL
YNELNLGRREEYDVLDKRRGRDPEMGGKPRRKNPQEGLYNELQKDKMAEAYSEIGMKGERRRGKGHDGLYQGLSTATKDT
YDALHMQALPPR (AS60685 + FSHβ 33-53 dual CAR amino acid sequence)

SEQ ID NO: 387

MALPVTALLLPLALLLHAARPQVQLVESGGGSVQAGGSLRLSCAASGNVYNNMCMGWFRQAPGKEREGVASMYVGGGYTY
YDDSVKGRFTISRDNAKNTLYLQMNSLKPEDTAMYYCAAISIALTREFCAPIVSRYNYWGQGTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPRGSGATNFSLLKQAGDVEENPGPMALPVT
ALLLPLALLLHAARPYTRDLVYKDPARPKIQKTCTFTTTPAPRPPTPAPTIASQPLSLRPEACRPAAGGAVHTRGLDFAC
DIYIWAPLAGTCGVLLLSLVITLYCRSKRSRLLHSDYMNMTPRRPGPTRKHYQPYAPPRDFAAYRSRVKFSRSADAPAYK
QGQNQLYNELNLGRREEYDVLDKRRGRDPEMGGKPRRKNPQEGLYNELQKDKMAEAYSEIGMKGERRRGKGHDGLYQGLS
TATKDTYDALHMQALPPR (AS60702 + FSHβ 33-53 dual CAR amino acid sequence)

SEQ ID NO: 388

MALPVTALLLPLALLLHAARPQVKLVESGGGSVQAGGSLRLSCAASGNVYNNMCMGWFRQAPGKEREGVASIYVGGGYTN
YADSVRGRFTISQDNAKNTLYLQMNSLKPEDTAMYYCAAITVALTRAFCAPIPSRYTNWGQGTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPRGSGATNFSLLKQAGDVEENPGPMALPVT
ALLLPLALLLHAARPYTRDLVYKDPARPKIQKTCTFTTTPAPRPPTPAPTIASQPLSLRPEACRPAAGGAVHTRGLDFAC
DIYIWAPLAGTCGVLLLSLVITLYCRSKRSRLLHSDYMNMTPRRPGPTRKHYQPYAPPRDFAAYRSRVKFSRSADAPAYK
QGQNQLYNELNLGRREEYDVLDKRRGRDPEMGGKPRRKNPQEGLYNELQKDKMAEAYSEIGMKGERRRGKGHDGLYQGLS
TATKDTYDALHMQALPPR (AS60676 + FSHβ 33-53 dual CAR amino acid sequence)

SEQ ID NO: 389

MALPVTALLLPLALLLHAARPQVQLVESGGGSVQAGGSLRLSCAASGYTVSSGCMGWFRQAPGKERERVAQIGRDATTTY
ADSVKGRFTIARDDAENTLYLQMNSLKPEDTAMYSCTAYWGVYCLSPGRYWGQGTQVTVSSTTTPAPRPPTPAPTIASQP
LSLRPEACRPAAGGAVHTRGLDFACDIYIWAPLAGTCGVLLLSLVITLYCKRGRKKLLYIFKQPFMRPVQTTQEEDGCSC
RFPEEEEGGCELRVKFSRSADAPAYKQGQNQLYNELNLGRREEYDVLDKRRGRDPEMGGKPRRKNPQEGLYNELQKDKMA
EAYSEIGMKGERRRGKGHDGLYQGLSTATKDTYDALHMQALPPRGSGATNFSLLKQAGDVEENPGPMALPVTALLLPLAL
LLHAARPYTRDLVYKDPARPKIQKTCTFTTTPAPRPPTPAPTIASQPLSLRPEACRPAAGGAVHTRGLDFACDIYIWAPL
AGTCGVLLLSLVITLYCRSKRSRLLHSDYMNMTPRRPGPTRKHYQPYAPPRDFAAYRSRVKFSRSADAPAYKQGQNQLYN
ELNLGRREEYDVLDKRRGRDPEMGGKPRRKNPQEGLYNELQKDKMAEAYSEIGMKGERRRGKGHDGLYQGLSTATKDTYD
ALHMQALPPR (AD58-1-26VH3VL1 CAR with dnTGFβ RII amino acid sequence)

SEQ ID NO: 390

MALPVTALLLPLALLLHAARPQVQLVQSGAEVKKPGASVKVSCKASGYTFTSYWMHWVKQAPGQGLEWIGYINPSTGHTD
YNQKFKDRATLTADTSTSTVYMELSSLRSEDTAVYYCARSNWAWFPYWGQGTLVTVSSGGGGSGGGGSGGGGSDIVMTQS
PDSLAVSLGERATINCKSSQSLLNSGNQKNYLTWYQQKPGQPPKLLIYWASTRESGVPDRFSGSGSGTDFTLTISSLQAE
DVAVYYCQNDYSYPLTFGGGTKLEIKTTTPAPRPPTPAPTIASQPLSLRPEACRPAAGGAVHTRGLDFACDIYIWAPLAG
TCGVLLLSLVITLYCKRGRKKLLYIFKQPFMRPVQTTQEEDGCSCRFPEEEEGGCELRVKFSRSADAPAYKQGQNQLYNE
LNLGRREEYDVLDKRRGRDPEMGGKPRRKNPQEGLYNELQKDKMAEAYSEIGMKGERRRGKGHDGLYQGLSTATKDTYDA
LHMQALPPRGSGATNFSLLKQAGDVEENPGPMGRGLLRGLWPLHIVLWTRIASTIPPHVQKSVNNDMIVTDNNGAVKFPQ
LCKFCDVRFSTCDNQKSCMSNCSITSICEKPQEVCVAVWRKNDENITLETVCHDPKLPYHDFILEDAASPKCIMKEKKKP
GETFFMCSCSSDECNDNIIFSEEYNTSNPDLLLVIFQVTGISLLPPLGVAISVIIIFYCYRVNRQQKLSS (AS51489 CAR with dnTGFβ RII amino acid sequence)

SEQ ID NO: 391

MALPVTALLLPLALLLHAARPEVQLVESGGGLVQPGGSLRLSCAASGENLYYYSIHWVRQAPGKGLEWVAYISSSSSYTY
YADSVKGRFTISADTSKNTAYLQMNSLRAEDTAVYYCARYYPYYGMDYWGQGTLVTVSSGGGGSGGGGSGGGGSDIQMTQ
SPSSLSASVGDRVTITCRASQSVSSAVAWYQQKPGKAPKLLIYSASSLYSGVPSRFSGSRSGTDFTLTISSLQPEDFATY
YCQQGFSYYPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPRGSGATNFSLLKQAGDVEENPGPMGRGLLRGLWPLHIVLWTRIASTIPPHVQKSVNNDMIVTDNNGAVKFPQLCKF
CDVRFSTCDNQKSCMSNCSITSICEKPQEVCVAVWRKNDENITLETVCHDPKLPYHDFILEDAASPKCIMKEKKKPGETF
FMCSCSSDECNDNIIFSEEYNTSNPDLLLVIFQVTGISLLPPLGVAISVIIIFYCYRVNRQQKLSS (AS92110 CAR with dnTGFβ RII amino acid sequence)

SEQ ID NO: 392

MALPVTALLLPLALLLHAARPEVQLVESGGGLVQPGGSLRLSCAASGENIYYSSMHWVRQAPGKGLEWVAYIYPYYSYTY
YADSVKGRFTISADTSKNTAYLQMNSLRAEDTAVYYCARGYALDYWGQGTLVTVSSGGGGGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QASSGYHYLITFGQGTKVEIKTTTPAPRPPTPAPTIASQPLSLRPEACRPAAGGAVHTRGLDFACDIYIWAPLAGTCGVL
LLSLVITLYCKRGRKKLLYIFKQPFMRPVQTTQEEDGCSCRFPEEEEGGCELRVKFSRSADAPAYKQGQNQLYNELNLGR
REEYDVLDKRRGRDPEMGGKPRRKNPQEGLYNELQKDKMAEAYSEIGMKGERRRGKGHDGLYQGLSTATKDTYDALHMQA

-continued

LPPRGSGATNFSLLKQAGDVEENPGMGRGLLRGLWPLHIVLWTRIASTIPPHVQKSVNNDMIVTDNNGAVKFPQLCKFC
DVRFSTCDNQKSCMSNCSITSICEKPQEVCVAVWRKNDENITLETVCHDPKLPYHDFILEDAASPKCIMKEKKKPGETFF
MCSCSSDECNDNIIFSEEYNTSNPDLLLVIFQVTGISLLPPLGVAISVIIIFYCYRVNRQQKLSS (AS91156 CAR with dnTGFβ RII amino acid sequence)

SEQ ID NO: 393

MALPVTALLLPLALLLHAARPEVQLVESGGGLVQPGGSLRLSCAASGFNIYSSSIHWVRQAPGKGLEWVASISSYSSYTS
YADSVKGRFTISADTSKNTAYLQMNSLRAEDTAVYYCARYYAMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QGPYYHPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PRGSGATNFSLLKQAGDVEENPGMGRGLLRGLWPLHIVLWTRIASTIPPHVQKSVNNDMIVTDNNGAVKFPQLCKFCDV
RFSTCDNQKSCMSNCSITSICEKPQEVCVAVWRKNDENITLETVCHDPKLPYHDFILEDAASPKCIMKEKKKPGETFFMC
SCSSDECNDNIIFSEEYNTSNPDLLLVIFQVTGISLLPPLGVAISVIIIFYCYRVNRQQKLSS (AS91189 CAR with dnTGFβ RII amino acid sequence)

SEQ ID NO: 394

MALPVTALLLPLALLLHAARPEVQLVESGGGLVQPGGSLRLSCAASGFNLSYSSIHWVRQAPGKGLEWVASIYSYSGSTY
YADSVKGRFTISADTSKNTAYLQMNSLRAEDTAVYYCARYWGMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QYYWYPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PRGSGATNFSLLKQAGDVEENPGMGRGLLRGLWPLHIVLWTRIASTIPPHVQKSVNNDMIVTDNNGAVKFPQLCKFCDV
RFSTCDNQKSCMSNCSITSICEKPQEVCVAVWRKNDENITLETVCHDPKLPYHDFILEDAASPKCIMKEKKKPGETFFMC
SCSSDECNDNIIFSEEYNTSNPDLLLVIFQVTGISLLPPLGVAISVIIIFYCYRVNRQQKLSS (AS51674 CAR with dnTGFβ RII amino acid sequence)

SEQ ID NO: 395

MALPVTALLLPLALLLHAARPEVQLVESGGGLVQPGGSLRLSCAASGENLYSYYMHWVRQAPGKGLEWVASIYSYSSYTS
YADSVKGRFTISADTSKNTAYLQMNSLRAEDTAVYYCARPFGWGYAGMDYWGQGTLVTVSSGGGGSGGGGSGGGGSDIQM
TQSPSSLSASVGDRVTITCRASQSVSSAVAWYQQKPGKAPKLLIYSASSLYSGVPSRFSGSRSGTDFTLTISSLQPEDFA
TYYCQQGYAPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPRGSGATNFSLLKQAGDVEENPGMGRGLLRGLWPLHIVLWTRIASTIPPHVQKSVNNDMIVTDNNGAVKFPQLCKE
CDVRFSTCDNQKSCMSNCSITSICEKPQEVCVAVWRKNDENITLETVCHDPKLPYHDFILEDAASPKCIMKEKKKPGETF
FMCSCSSDECNDNIIFSEEYNTSNPDLLLVIFQVTGISLLPPLGVAISVIIIFYCYRVNRQQKLSS (AS65233 CAR with dnTGFβ RII amino acid sequence)

SEQ ID NO: 396

MALPVTALLLPLALLLHAARPQVHLVESGGGSVQAGGSLRLSCAASEFTYSMGWFRQAPGKEREGVAHIYTRGGTTVYAD
SVKGRFVLSRYNAKSIMYLQMNSVKLEDTAMYYCAARTIFEGSWSSPSSFDFWGQGTQVTVSSTTTPAPRPPTPAPTIAS
QPLSLRPEACRPAAGGAVHTRGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMGGKPRRKNPQEGLYNELQKDK
MAEAYSEIGMKGERRRGKGHDGLYQGLSTATKDTYDALHMQALPPRGSGATNFSLLKQAGDVEENPGMGRGLLRGLWPL
HIVLWTRIASTIPPHVQKSVNNDMIVTDNNGAVKFPQLCKFCDVRFSTCDNQKSCMSNCSITSICEKPQEVCVAVWRKND
ENITLETVCHDPKLPYHDFILEDAASPKCIMKEKKKPGETFFMCSCSSDECNDNIIFSEEYNTSNPDLLLVIFQVTGISL
LPPLGVAISVIIIFYCYRVNRQQKLSS (AS60685 CAR with dnTGFβ RII amino acid sequence)

SEQ ID NO: 397

MALPVTALLLPLALLLHAARPQVQLVESGGGSVQAGGSLRLSCAASGNVYNNMCMGWFRQAPGKEREGVASMYVGGGYTY
YDDSVKGRFTISRDNAKNTLYLQMNSLKPEDTAMYYCAAISIALTREFCAPIVSRYNYWGGQTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPRGSGATNFSLLKQAGDVEENPGMGRGLL
RGLWPLHIVLWTRIASTIPPHVQKSVNNDMIVTDNNGAVKFPQLCKFCDVRFSTCDNQKSCMSNCSITSICEKPQEVCVA
VWRKNDENITLETVCHDPKLPYHDFILEDAASPKCIMKEKKKPGETFFMCSCSSDECNDNIIFSEEYNTSNPDLLLVIFQ
VTGISLIPPLGVAISVIIIFYCYRVNRQQKLSS (AS60702 CAR with dnTGFβ RII amino acid sequence)

SEQ ID NO: 398

MALPVTALLLPLALLLHAARPQVKLVESGGGSVQAGGSLRLSCAASGNVYNNMCMGWFRQAPGKEREGVASIYVGGGYTN
YADSVRGRFTISQDNAKNTLYLQMNSLKPEDTAMYYCAAITVALTRAFCAPIPSRYTNWGQGTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPRGSGATNFSLLKQAGDVEENPGMGRGLL
RGLWPLHIVLWTRIASTIPPHVQKSVNNDMIVTDNNGAVKFPQLCKFCDVRFSTCDNQKSCMSNCSITSICEKPQEVCVA
VWRKNDENITLETVCHDPKLPYHDFILEDAASPKCIMKEKKKPGETFFMCSCSSDECNDNIIFSEEYNTSNPDLLLVIFQ
VTGISLLPPLGVAISVIIIFYCYRVNRQQKLSS (AS60676 CAR with dnTGFβ RII amino acid sequence)

SEQ ID NO: 399

MALPVTALLLPLALLLHAARPQVQLVESGGGSVQAGGSLRLSCAASGYTVSSGCMGWFRQAPGKERERVAQIGRDATTTY
ADSVKGRFTIARDDAENTLYLQMNSLKPEDTAMYSCTAYWGVYCLSPGRYWGQGTQVTVSSTTTPAPRPPTPAPTIASQP
LSLRPEACRPAAGGAVHTRGLDFACDIYIWAPLAGTCGVLLLSLVITLYCKRGRKKLLYIFKQPFMRPVQTTQEEDGCSC
RFPEEEEGGCELRVKFSRSADAPAYKQGQNQLYNELNLGRREEYDVLDKRRGRDPEMGGKPRRKNPQEGLYNELQKDKMA
EAYSEIGMKGERRRGKGHDGLYQGLSTATKDTYDALHMQALPPRGSGATNFSLLKQAGDVEENPGMGRGLLRGLWPLHI
VLWTRIASTIPPHVQKSVNNDMIVTDNNGAVKFPQLCKFCDVRFSTCDNQKSCMSNCSITSICEKPQEVCVAVWRKNDEN

ITLETVCHDPKLPYHDFILEDAASPKCIMKEKKKPGETFFMCSCSSDECNDNIIFSEEYNTSNPDLLLVIFQVTGISLLP
PLGVAISVIIIFYCYRVNRQQKLSS (FSHβ 33-53 + AD58126VH3VL1 tandem CAR with dnTGFβ RII amino acid sequence)
SEQ ID NO: 400
MALPVTALLLPLALLLHAARPYTRDLVYKDPARPKIQKTCTFGGGGSGGGGSGGGGSQVQLVQSGAEVKKPGASVKVSCK
ASGYTFTSYWMHWVKQAPGQGLEWIGYINPSTGHTDYNQKFKDRATLTADTSTSTVYMELSSLRSEDTAVYYCARSNWAW
FPYWGQGTLVTVSSGGGGSGGGGSGGGGSDIVMTQSPDSLAVSLGERATINCKSSQSLLNSGNQKNYLTWYQQKPGQPPK
LLIYWASTRESGVPDRFSGSGSGTDFTLTISSLQAEDVAVYYCQNDYSYPLTFGQGTKLEIKTTTPAPRPPTPAPTIASQ
PLSLRPEACRPAAGGAVHTRGLDFACDIYIWAPLAGTCGVLLLSLVITLYCKRGRKKLLYIFKQPFMRPVQTTQEEDGCS
CRFPEEEEGGCELRVKFSRSADAPAYKQGQNQLYNELNLGRREEYDVLDKRRGRDPEMGGKPRRKNPQEGLYNELQKDKM
AEAYSEIGMKGERRRGKGHDGLYQGLSTATKDTYDALHMQALPPRGSGATNFSLLKQAGDVEENPGPMGRGLLRGLWPLH
IVLWTRIASTIPPHVQKSVNNDMIVTDNNGAVKFPQLCKFCDVRFSTCDNQKSCMSNCSITSICEKPQEVCVAVWRKNDE
NITLETVCHDPKLPYHDFILEDAASPKCIMKEKKKPGETFFMCSCSSDECNDNIIFSEEYNTSNPDLLLVIFQVTGISLL
PPLGVAISVIIIFYCYRVNRQQKLSS (FSHβ 33-53 + AS51489 tandem CAR with dnTGFβ RII amino acid sequence)
SEQ ID NO: 401
MALPVTALLLPLALLLHAARPYTRDLVYKDPARPKIQKTCTFGGGGSGGGGSGGGGSEVQLVESGGGLVQPGGSLRLSCA
ASGFNLYYYSIHWVRQAPGKGLEWVAYISSSSSYTYYADSVKGRFTISADTSKNTAYLQMNSLRAEDTAVYYCARYPPYY
GMDYWGQGTLVTVSSGGGGSGGGGSGGGGSDIQMTQSPSSLSASVGDRVTITCRASQSVSSAVAWYQQKPGKAPKLLIYS
ASSLYSGVPSRFSGSRSGTDFTLTISSLQPEDFATYYCQQGFSYYPITFGQGTKVEIKTTTTPAPRPPTPAPTIASQPLSL
RPEACRPAAGGAVHTRGLDFACDIYIWAPLAGTCGVLLLSLVITLYCKRGRKKLLYIFKQPFMRPVQTTQEEDGCSCRFP
EEEEGGCELRVKFSRSADAPAYKQGQNQLYNELNLGRREEYDVLDKRRGRDPEMGGKPRRKNPQEGLYNELQKDKMAEAY
SEIGMKGERRRGKGHDGLYQGLSTATKDTYDALHMQALPPRGSGATNFSLLKQAGDVEENPGPMGRGLLRGLWPLHIVLW
TRIASTIPPHVQKSVNNDMIVTDNNGAVKFPQLCKFCDVRFSTCDNQKSCMSNCSITSICEKPQEVCVAVWRKNDENITL
ETVCHDPKLPYHDFILEDAASPKCIMKEKKKPGETFFMCSCSSDECNDNIIFSEEYNTSNPDLLLVIFQVTGISLLPPLG
VAISVIIIFYCYRVNRQQKLSS (FSHβ 33-53 + AS92110 tandem CAR with dnTGFβ RII amino acid sequence)
SEQ ID NO: 402
MALPVTALLLPLALLLHAARPYTRDLVYKDPARPKIQKTCTFGGGGSGGGGSGGGGSEVQLVESGGGLVQPGGSLRLSCA
ASGFNIYYSSMHWVRQAPGKGLEWVAYIYPYYSYTYYADSVKGRFTISADTSKNTAYLQMNSLRAEDTAVYYCARGYALD
YWGQGTLVTVSSGGGGSGGGGSGGGGSDIQMTQSPSSLSASVGDRVTITCRASQSVSSAVAWYQQKPGKAPKLLIYSASS
LYSGVPSRFSGSRSGTDFTLTISSLQPEDFATYYCQQASSGYHYLITFGQGTKVEIKTTTTPAPRPPTPAPTIASQPLSLR
PEACRPAAGGAVHTRGLDFACDIYIWAPLAGTCGVLLLSLVITLYCKRGRKKLLYIFKQPFMRPVQTTQEEDGCSCRFPE
EEEGGCELRVKFSRSADAPAYKQGQNQLYNELNLGRREEYDVLDKRRGRDPEMGGKPRRKNPQEGLYNELQKDKMAEAYS
EIGMKGERRRGKGHDGLYQGLSTATKDTYDALHMQALPPRGSGATNFSLLKQAGDVEENPGPMGRGLLRGLWPLHIVLWT
RIASTIPPHVQKSVNNDMIVTDNNGAVKFPQLCKFCDVRFSTCDNQKSCMSNCSITSICEKPQEVCVAVWRKNDENITLE
TVCHDPKLPYHDFILEDAASPKCIMKEKKKPGETFFMCSCSSDECNDNIIFSEEYNTSNPDLLLVIFQVTGISLIPPLGV
AISVIIIFYCYRVNRQQKLSS (FSHβ 33-53 + AS91156 tandem CAR with dnTGFβ RII amino acid sequence)
SEQ ID NO: 403
MALPVTALLLPLALLLHAARPYTRDLVYKDPARPKIQKTCTFGGGGSGGGGSGGGGSEVQLVESGGGLVQPGGSLRLSCA
ASGFNIYSSSIHWVRQAPGKGLEWVASISSYSSYTSYADSVKGRFTISADTSKNTAYLQMNSLRAEDTAVYYCARYYAMD
YWGQGTLVTVSSGGGGSGGGGSGGGGSDIQMTQSPSSLSASVGDRVTITCRASQSVSSAVAWYQQKPGKAPKLLIYSASS
LYSGVPSRFSGSRSGTDFTLTISSLQPEDFATYYCQQGPYYHPITFGQGTKVEIKTTTTPAPRPPTPAPTIASQPLSLRPE
ACRPAAGGAVHTRGLDFACDIYIWAPLAGTCGVLLLSLVITLYCKRGRKKLLYIFKQPFMRPVQTTQEEDGCSCRFPEEE
EGGCELRVKFSRSADAPAYKQGQNQLYNELNLGRREEYDVLDKRRGRDPEMGGKPRRKNPQEGLYNELQKDKMAEAYSEI
GMKGERRRGKGHDGLYQGLSTATKDTYDALHMQALPPRGSGATNFSLLKQAGDVEENPGPMGRGLLRGLWPLHIVLWTRI
ASTIPPHVQKSVNNDMIVTDNNGAVKFPQLCKFCDVRFSTCDNQKSCMSNCSITSICEKPQEVCVAVWRKNDENITLETV
CHDPKLPYHDFILEDAASPKCIMKEKKKPGETFFMCSCSSDECNDNIIFSEEYNTSNPDLLLVIFQVTGISLLPPLGVAI
SVIIIFYCYRVNRQQKLSS (FSHβ 33-53 + AS91189 tandem CAR with dnTGFβ RII amino acid sequence)
SEQ ID NO: 404
MALPVTALLLPLALLLHAARPYTRDLVYKDPARPKIQKTCTFGGGGSGGGGSGGGGSEVQLVESGGGLVQPGGSLRLSCA
ASGFNLSYSSIHWVRQAPGKGLEWVASIYSYSGSTYYADSVKGRFTISADTSKNTAYLQMNSLRAEDTAVYYCARYWGMD
YWGQGTLVTVSSGGGGSGGGGSGGGGSDIQMTQSPSSLSASVGDRVTITCRASQSVSSAVAWYQQKPGKAPKLLIYSASS
LYSGVPSRFSGSRSGTDFTLTISSLQPEDFATYYCQQYYWYYPITFGQGTKVEIKTTTTPAPRPPTPAPTIASQPLSLRPE
ACRPAAGGAVHTRGLDFACDIYIWAPLAGTCGVLLLSLVITLYCKRGRKKLLYIFKQPFMRPVQTTQEEDGCSCRFPEEE
EGGCELRVKFSRSADAPAYKQGQNQLYNELNLGRREEYDVLDKRRGRDPEMGGKPRRKNPQEGLYNELQKDKMAEAYSEI
GMKGERRRGKGHDGLYQGLSTATKDTYDALHMQALPPRGSGATNFSLLKQAGDVEENPGPMGRGLLRGLWPLHIVLWTRI
ASTIPPHVQKSVNNDMIVTDNNGAVKFPQLCKFCDVRFSTCDNQKSCMSNCSITSICEKPQEVCVAVWRKNDENITLETV
CHDPKLPYHDFILEDAASPKCIMKEKKKPGETFFMCSCSSDECNDNIIFSEEYNTSNPDLLLVIFQVTGISLLPPLGVAI
SVIIIFYCYRVNRQQKLSS (FSHβ 33-53 + AS51674 tandem CAR with dnTGFβ RII amino acid sequence)
SEQ ID NO: 405
MALPVTALLLPLALLLHAARPYTRDLVYKDPARPKIQKTCTFGGGGSGGGGSGGGGSEVQLVESGGGLVQPGGSLRLSCA
ASGFNLYSYYMHWVRQAPGKGLEWVASIYSYSYTSYADSVKGRFTISADTSKNTAYLQMNSLRAEDTAVYYCARPPGWG
YAGMDYWGQGTLVTVSSGGGGSGGGGSGGGGSDIQMTQSPSSLSASVGDRVTITCRASQSVSSAVAWYQQKPGKAPKLLI
YSASSLYSGVPSRFSGSRSGTDFTLTISSLQPEDFATYYCQQGYAPITFGQGTKVEIKTTTTPAPRPPTPAPTIASQPLSL
RPEACRPAAGGAVHTRGLDFACDIYIWAPLAGTCGVLLLSLVITLYCKRGRKKLLYIFKQPFMRPVQTTQEEDGCSCRFP
EEEEGGCELRVKFSRSADAPAYKQGQNQLYNELNLGRREEYDVLDKRRGRDPEMGGKPRRKNPQEGLYNELQKDKMAEAY
SEIGMKGERRRGKGHDGLYQGLSTATKDTYDALHMQALPPRGSGATNFSLLKQAGDVEENPGPMGRGLLRGLWPLHIVLW
TRIASTIPPHVQKSVNNDMIVTDNNGAVKFPQLCKFCDVRFSTCDNQKSCMSNCSITSICEKPQEVCVAVWRKNDENITL
ETVCHDPKLPYHDFILEDAASPKCIMKEKKKPGETFFMCSCSSDECNDNIIFSEEYNTSNPDLLLVIFQVTGISLLPPLG
VAISVIIIFYCYRVNRQQKLSS -continued (FSHβ 33-53 + AS65233 tandem CAR with dnTGFβ RII amino acid sequence)
SEQ ID NO: 406
MALPVTALLLPLALLLHAARPYTRDLVYKDPARPKIQKTCTFGGGGSGGGGSGGGGSQVHLVESGGGSVQAGGSLRLSCA
ASEFTYSMGWFRQAPGKEREGVAHIYTRGGTTVYADSVKGRFVLSRYNAKSIMYLQMNSVKLEDTAMYYCAARTIFEGSW
SSPSSFDFWGQGTQVTVSSTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PRGSGATNFSLLKQAGDVEENPGPMGRGLLRGLWPLHIVLWTRIASTIPPHVQKSVNNDMIVTDNNGAVKFPQLCKFCDV
RFSTCDNQKSCMSNCSITSICEKPQEVCVAVWRKNDENITLETVCHDPKLPYHDFILEDAASPKCIMKEKKKPGETFFMC
SCSSDECNDNIIFSEEYNTSNPDLLLVIFQVTGISLLPPLGVAISVIIIFYCYRVNRQQKLSS (FSHβ 33-53 + AS60685 tandem CAR with dnTGFβ RII amino acid sequence)
SEQ ID NO: 407
MALPVTALLLPLALLLHAARPYTRDLVYKDPARPKIQKTCTFGGGGSGGGGSGGGGSQVQLVESGGGSVQAGGSLRLSCA
ASGNVYNNMCMGWFRQAPGKEREGVASMYVGGGYTYYDDSVKGRFTISRDNAKNTLYLQMNSLKPEDTAMYYCAAISIAL
TREFCAPIVSRYNYWGQGTQVTVSSTTTPAPRPPTPAPTIASQPLSLRPEACRPAAGGAVHTRGLDFACDIYIWAPLAGT
CGVLLLSLVITLYCKRGRKKLLYIFKQPFMRPVQTTQEEDGCSCRFPEEEEGGCELRVKFSRSADAPAYKQGQNQLYNEL
NLGRREEYDVLDKRRGRDPEMGGKPRRKNPQEGLYNELQKDKMAEAYSEIGMKGERRRGKGHDGLYQGLSTATKDTYDAL
HMQALPPRGSGATNFSLLKQAGDVEENPGPMGRGLLRGLWPLHIVLWTRIASTIPPHVQKSVNNDMIVTDNNGAVKFPQL
CKFCDVRFSTCDNQKSCMSNCSITSICEKPQEVCVAVWRKNDENITLETVCHDPKLPYHDFILEDAASPKCIMKEKKKPG
ETFFMCSCSSDECNDNIIFSEEYNTSNPDLLLVIFQVTGISLLPPLGVAISVIIIFYCYRVNRQQKLSS (FSHβ 33-53 + AS60702 tandem CAR with dnTGFβ RII amino acid sequence)
SEQ ID NO: 408
MALPVTALLLPLALLLHAARPYTRDLVYKDPARPKIQKTCTFGGGGSGGGGSGGGGSQVKLVESGGGSVQAGGSLRLSCA
ASGNVYNNMCMGWFRQAPGKEREGVASIYVGGGYTNYADSVRGRFTISQDNAKNTLYLQMNSLKPEDTAMYYCAAITVAL
TRAFCAPIPSRYTNWGQGTQVTVSSTTTPAPRPPTPAPTIASQPLSLRPEACRPAAGGAVHTRGLDFACDIYIWAPLAGT
CGVLLLSLVITLYCKRGRKKLLYIFKQPFMRPVQTTQEEDGCSCRFPEEEEGGCELRVKFSRSADAPAYKQGQNQLYNEL
NLGRREEYDVLDKRRGRDPEMGGKPRRKNPQEGLYNELQKDKMAEAYSEIGMKGERRRGKGHDGLYQGLSTATKDTYDAL
HMQALPPRGSGATNFSLLKQAGDVEENPGPMGRGLLRGLWPLHIVLWTRIASTIPPHVQKSVNNDMIVTDNNGAVKFPQL
CKFCDVRFSTCDNQKSCMSNCSITSICEKPQEVCVAVWRKNDENITLETVCHDPKLPYHDFILEDAASPKCIMKEKKKPG
ETFFMCSCSSDECNDNIIFSEEYNTSNPDLLLVIFQVTGISLLPPLGVAISVIIIFYCYRVNRQQKLSS (FSHβ 33-53 + AS60676 tandem CAR with dnTGFβ RII amino acid sequence)
SEQ ID NO: 409
MALPVTALLLPLALLLHAARPYTRDLVYKDPARPKIQKTCTFGGGGSGGGGSGGGGSQVQLVESGGGSVQAGGSLRLSCA
ASGYTVSSGCMGWFRQAPGKERERVAQIGRDATTTYADSVKGRFTIARDDAENTLYLQMNSLKPEDTAMYSCTAYWGVYC
LSPGRYWGQGTQVTVSSTTTPAPRPPTPAPTIASQPLSLRPEACRPAAGGAVHTRGLDFACDIYIWAPLAGTCGVLLLSL
VITLYCKRGRKKLLYIFKQPFMRPVQTTQEEDGCSCRFPEEEEGGCELRVKFSRSADAPAYKQGQNQLYNELNLGRREEY
DVLDKRRGRDPEMGGKPRRKNPQEGLYNELQKDKMAEAYSEIGMKGERRRGKGHDGLYQGLSTATKDTYDALHMQALPPR
GSGATNFSLLKQAGDVEENPGPMGRGLLRGLWPLHIVLWTRIASTIPPHVQKSVNNDMIVTDNNGAVKFPQLCKFCDVRF
STCDNQKSCMSNCSITSICEKPQEVCVAVWRKNDENITLETVCHDPKLPYHDFILEDAASPKCIMKEKKKPGETFFMCSC
SSDECNDNIIFSEEYNTSNPDLLLVIFQVTGISLLPPLGVAISVIIIFYCYRVNRQQKLSS (AD58-1-26VH3VL1 + FSHβ 33-53 dual CAR with dnTGFβ RII amino acid sequence)
SEQ ID NO: 410
MALPVTALLLPLALLLHAARPQVQLVQSGAEVKKPGASVKVSCKASGYTFTSYWMHWVKQAPGQGLEWIGYINPSTGHTD
YNQKFKDRATLTADTSTSTVYMELSSLRSEDTAVYYCARSNWAWFPYWGQGTLVTVSSGGGGSGGGGSGGGGSDIVMTQS
PDSLAVSLGERATINCKSSQSLLNSGNQKNYLTWYQQKPGQPPKLLIYWASTRESGVPDRFSGSGSGTDFTLTISSLQAE
DVAVYYCQNDYSYPLTFGGGTKLEIKTTTPAPRPPTPAPTIASQPLSLRPEACRPAAGGAVHTRGLDFACDIYIWAPLAG
TCGVLLLSLVITLYCKRGRKKLLYIFKQPFMRPVQTTQEEDGCSCRFPEEEEGGCELRVKFSRSADAPAYKQGQNQLYNE
LNLGRREEYDVLDKRRGRDPEMGGKPRRKNPQEGLYNELQKDKMAEAYSEIGMKGERRRGKGHDGLYQGLSTATKDTYDA
LHMQALPPRGSGATNFSLLKQAGDVEENPGPMALPVTALLLPLALLLHAARPYTRDLVYKDPARPKIQKTCTFTTTPAPR
PPTPAPTIASQPLSLRPEACRPAAGGAVHTRGLDFACDIYIWAPLAGTCGVLLLSLVITLYCRSKRSRLLHSDYMNMTPR
RPGPTRKHYQPYAPPRDFAAYRSRVKFSRSADAPAYKQGQNQLYNELNLGRREEYDVLDKRRGRDPEMGGKPRRKNPQEG
LYNELQKDKMAEAYSEIGMKGERRRGKGHDGLYQGLSTATKDTYDALHMQALPPRGSGATNFSLLKQAGDVEENPGPMGR
GLLRGLWPLHIVLWTRIASTIPPHVQKSVNNDMIVTDNNGAVKFPQLCKFCDVRFSTCDNQKSCMSNCSITSICEKPQEV
CVAVWRKNDENITLETVCHDPKLPYHDFILEDAASPKCIMKEKKKPGETFFMCSCSSDECNDNIIFSEEYNTSNPDLLLV
IFQVTGISLLPPLGVAISVIIIFYCYRVNRQQKLSS (AS51489 + FSHβ 33-53 dual CAR with dnTGFβ RII amino acid sequence)
SEQ ID NO: 411
MALPVTALLLPLALLLHAARPEVQLVESGGGLVQPGGSLRLSCAASGENLYYYSIHWVRQAPGKGLEWVAYISSSSSYTY
YADSVKGRFTISADTSKNTAYLQMNSLRAEDTAVYYCARYYPYYGMDYWGQGTLVTVSSGGGGSGGGGSGGGGSDIQMTQ
SPSSLSASVGDRVTITCRASQSVSSAVAWYQQKPGKAPKLLIYSASSLYSGVPSRFSGSRSGTDFTLTISSLQPEDFATY
YCQQGFSYYPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPRGSGATNFSLLKQAGDVEENPGPMALPVTALLLPLALLLHAARPYTRDLVYKDPARPKIQKTCTFTTTPAPRPPTP
APTIASQPLSLRPEACRPAAGGAVHTRGLDFACDIYIWAPLAGTCGVLLLSLVITLYCRSKRSRLLHSDYMNMTPRRPGP
TRKHYQPYAPPRDFAAYRSRVKFSRSADAPAYKQGQNQLYNELNLGRREEYDVLDKRRGRDPEMGGKPRRKNPQEGLYNE
LQKDKMAEAYSEIGMKGERRRGKGHDGLYQGLSTATKDTYDALHMQALPPRGSGATNFSLLKQAGDVEENPGPMGRGLLR
GLWPLHIVLWTRIASTIPPHVQKSVNNDMIVTDNNGAVKFPQLCKFCDVRFSTCDNQKSCMSNCSITSICEKPQEVCVAV
WRKNDENITLETVCHDPKLPYHDFILEDAASPKCIMKEKKKPGETFFMCSCSSDECNDNIIFSEEYNTSNPDLLLVIFQV
TGISLLPPLGVAISVIIIFYCYRVNRQQKLSS (AS92110 + FSHβ 33-53 dual CAR with dnTGFβ RII amino acid sequence)
SEQ ID NO: 412
MALPVTALLLPLALLLHAARPEVQLVESGGGLVQPGGSLRLSCAASGENIYYSSMHWVRQAPGKGLEWVAYIYPYYSYTY
YADSVKGRFTISADTSKNTAYLQMNSLRAEDTAVYYCARGYALDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ -continued QASSGYHYLITFGQGTKVEIKTTTPAPRPPTPAPTIASQPLSLRPEACRPAAGGAVHTRGLDFACDIYIWAPLAGTCGVL
LLLSLVITLYCKRGRKKLLYIFKQPFMRPVQTTQEEDGCSCRFPEEEEGGCELRVKFSRSADAPAYKQGQNQLYNELNLGR
REEYDVLDKRRGRDPEMGGKPRRKNPQEGLYNELQKDKMAEAYSEIGMKGERRRGKGHDGLYQGLSTATKDTYDALHMQA
LPPRGSGATNFSLLKQAGDVEENPGPMALPVTALLLPLALLLHAARPYTRDLVYKDPARPKIQKTCTFTTTPAPRPPTPA
PTIASQPLSLRPEACRPAAGGAVHTRGLDFACDIYIWAPLAGTCGVLLLSLVITLYCRSKRSRLLHSDYMNMTPRRPGPT
RKHYQPYAPPRDFAAYRSRVKFSRSADAPAYKQGQNQLYNELNLGRREEYDVLDKRRGRDPEMGGKPRRKNPQEGLYNEL
QKDKMAEAYSEIGMKGERRRGKGHDGLYQGLSTATKDTYDALHMQALPPRGSGATNFSLLKQAGDVEENPGPMGRGLLRG
LWPLHIVLWTRIASTIPPHVQKSVNNDMIVTDNNGAVKFPQLCKFCDVRFSTCDNQKSCMSNCSITSICEKPQEVCVAVW
RKNDENITLETVCHDPKLPYHDFILEDAASPKCIMKEKKKPGETFFMCSCSSDECNDNIIFSEEYNTSNPDLLLVIFQVT
GISLLPPLGVAISVIIIFYCYRVNRQQKLSS (AS91156 + FSHβ 33-53 dual CAR with dnTGFβ RII amino acid sequence)
SEQ ID NO: 413
MALPVTALLLPLALLLHAARPEVQLVESGGGLVQPGGSLRLSCAASGENIYSSSIHWVRQAPGKGLEWVASISSYSSYTS
YADSVKGRFTISADTSKNTAYLQMNSLRAEDTAVYYCARYYAMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QGPYYHPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PRGSGATNFSLLKQAGDVEENPGPMALPVTALLLPLALLLHAARPYTRDLVYKDPARPKIQKTCTFTTTPAPRPPTPAPT
IASQPLSLRPEACRPAAGGAVHTRGLDFACDIYIWAPLAGTCGVLLLSLVITLYCRSKRSRLLHSDYMNMTPRRPGPTRK
HYQPYAPPRDFAAYRSRVKFSRSADAPAYKQGQNQLYNELNLGRREEYDVLDKRRGRDPEMGGKPRRKNPQEGLYNELQK
DKMAEAYSEIGMKGERRRGKGHDGLYQGLSTATKDTYDALHMQALPPRGSGATNFSLLKQAGDVEENPGPMGRGLLRGLW
PLHIVLWTRIASTIPPHVQKSVNNDMIVTDNNGAVKFPQLCKFCDVRFSTCDNQKSCMSNCSITSICEKPQEVCVAVWRK
NDENITLETVCHDPKLPYHDFILEDAASPKCIMKEKKKPGETFFMCSCSSDECNDNIIFSEEYNTSNPDLLLVIFQVTGI
SLLPPLGVAISVIIIFYCYRVNRQQKLSS (AS91189 + FSHβ 33-53 dual CAR with dnTGFβ RII amino acid sequence)
SEQ ID NO: 414
MALPVTALLLPLALLLHAARPEVQLVESGGGLVQPGGSLRLSCAASGFNLSYSSIHWVRQAPGKGLEWVASIYSYSGSTY
YADSVKGRFTISADTSKNTAYLQMNSLRAEDTAVYYCARYWGMDYWGQGTLVTVSSGGGGSGGGGSGGGGSDIQMTQSPS
SLSASVGDRVTITCRASQSVSSAVAWYQQKPGKAPKLLIYSASSLYSGVPSRFSGSRSGTDFTLTISSLQPEDFATYYCQ
QYYWYYPITFGQGTKVEIKTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PRGSGATNFSLLKQAGDVEENPGPMALPVTALLLPLALLLHAARPYTRDLVYKDPARPKIQKTCTFTTTPAPRPPTPAPT
IASQPLSLRPEACRPAAGGAVHTRGLDFACDIYIWAPLAGTCGVLLLSLVITLYCRSKRSRLLHSDYMNMTPRRPGPTRK
HYQPYAPPRDFAAYRSRVKFSRSADAPAYKQGQNQLYNELNLGRREEYDVLDKRRGRDPEMGGKPRRKNPQEGLYNELQK
DKMAEAYSEIGMKGERRRGKGHDGLYQGLSTATKDTYDALHMQALPPRGSGATNFSLLKQAGDVEENPGPMGRGLLRGLW
PLHIVLWTRIASTIPPHVQKSVNNDMIVTDNNGAVKFPQLCKFCDVRFSTCDNQKSCMSNCSITSICEKPQEVCVAVWRK
NDENITLETVCHDPKLPYHDFILEDAASPKCIMKEKKKPGETFFMCSCSSDECNDNIIFSEEYNTSNPDLLLVIFQVTGI
SLLPPLGVAISVIIIFYCYRVNRQQKLSS (AS51674 + FSHβ 33-53 dual CAR with dnTGFβ RII amino acid sequence)
SEQ ID NO: 415
MALPVTALLLPLALLLHAARPEVQLVESGGGLVQPGGSLRLSCAASGENLYSYYMHWVRQAPGKGLEWVASIYSYSSYTS
YADSVKGRFTISADTSKNTAYLQMNSLRAEDTAVYYCARPFGWGYAGMDYWGQGTLVTVSSGGGGSGGGGSGGGGSDIQM
TQSPSSLSASVGDRVTITCRASQSVSSAVAWYQQKPGKAPKLLIYSASSLYSGVPSRFSGSRSGTDFTLTISSLQPEDFA
TYYCQQGYAPITFGQGTKVEIKTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPRGSGATNFSLLKQAGDVEENPGPMALPVTALLLPLALLLHAARPYTRDLVYKDPARPKIQKTCTFTTTPAPRPPTP
APTIASQPLSLRPEACRPAAGGAVHTRGLDFACDIYIWAPLAGTCGVLLLSLVITLYCRSKRSRLLHSDYMNMTPRRPGP
TRKHYQPYAPPRDFAAYRSRVKFSRSADAPAYKQGQNQLYNELNLGRREEYDVLDKRRGRDPEMGGKPRRKNPQEGLYNE
LQKDKMAEAYSEIGMKGERRRGKGHDGLYQGLSTATKDTYDALHMQALPPRGSGATNFSLLKQAGDVEENPGPMGRGLLR
GLWPLHIVLWTRIASTIPPHVQKSVNNDMIVTDNNGAVKFPQLCKFCDVRFSTCDNQKSCMSNCSITSICEKPQEVCVAV
WRKNDENITLETVCHDPKLPYHDFILEDAASPKCIMKEKKKPGETFFMCSCSSDECNDNIIFSEEYNTSNPDLLLVIFQV
TGISLLPPLGVAISVIIIFYCYRVNRQQKLSS (AS65233 + FSHβ 33-53 dual CAR with dnTGFβ RII amino acid sequence)
SEQ ID NO: 416
MALPVTALLLPLALLLHAARPQVHLVESGGGSVQAGGSLRLSCAASEFTYSMGWFRQAPGKEREGVAHIYTRGGTTVYAD
SVKGRFVLSRYNAKSIMYLQMNSVKLEDTAMYYCAARTIFEGSWSSPSSFDFWGQGTQVTVSSTTTPAPRPPTPAPTIAS
QPLSLRPEACRPAAGGAVHTRGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMGGKPRRKNPQEGLYNELQKDK
MAEAYSEIGMKGERRRGKGHDGLYQGLSTATKDTYDALHMQALPPRGSGATNFSLLKQAGDVEENPGPMALPVTALLLPL
ALLLHAARPYTRDLVYKDPARPKIQKTCTFTTTPAPRPPTPAPTIASQPLSLRPEACRPAAGGAVHTRGLDFACDIYIWA
PLAGTCGVLLLSLVITLYCRSKRSRLLHSDYMNMTPRRPGPTRKHYQPYAPPRDFAAYRSRVKFSRSADAPAYKQGQNQL
YNELNLGRREEYDVLDKRRGRDPEMGGKPRRKNPQEGLYNELQKDKMAEAYSEIGMKGERRRGKGHDGLYQGLSTATKDT
YDALHMQALPPRGSGATNFSLLKQAGDVEENPGPMGRGLLRGLWPLHIVLWTRIASTIPPHVQKSVNNDMIVTDNNGAVK
FPQLCKFCDVRFSTCDNQKSCMSNCSITSICEKPQEVCVAVWRKNDENITLETVCHDPKLPYHDFILEDAASPKCIMKEK
KKPGETFFMCSCSSDECNDNIIFSEEYNTSNPDLLLVIFQVTGISLLPPLGVAISVIIIFYCYRVNRQQKLSS (AS60685 + FSHβ 33-53 dual CAR with dnTGFβ RII amino acid sequence)
SEQ ID NO: 417
MALPVTALLLPLALLLHAARPQVQLVESGGGSVQAGGSLRLSCAASGNVYNNMCMGWFRQAPGKEREGVASMYVGGGYTY
YDDSVKGRFTISRDNAKNTLYLQMNSLKPEDTAMYYCAAISIALTREFCAPIVSRYNYWGQGTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPRGSGATNFSLLKQAGDVEENPGPMALPVT
ALLLPLALLLHAARPYTRDLVYKDPARPKIQKTCTFTTTPAPRPPTPAPTIASQPLSLRPEACRPAAGGAVHTRGLDFAC

```
                                     -continued
DIYIWAPLAGTCGVLLLSLVITLYCRSKRSRLLHSDYMNMTPRRPGPTRKHYQPYAPPRDFAAYRSRVKFSRSADAPAYK
QGGQNQLYNELNLGRREEYDVLDKRRGRDPEMGGKPRRKNPQEGLYNELQKDKMAEAYSEIGMKGERRRGKGHDGLYQGLS
TATKDTYDALHMQALPPRGSGATNFSLLKQAGDVEENPGPMGRGLLRGLWPLHIVLWTRIASTIPPHVQKSVNNDMIVTD
NNGAVKFPQLCKFCDVRFSTCDNQKSCMSNCSITSICEKPQEVCVAVWRKNDENITLETVCHDPKLPYHDFILEDAASPK
CIMKEKKKPGETFFMCSCSSDECNDNIIFSEEYNTSNPDLLLVIFQVTGISLLPPLGVAISVIIIFYCYRVNRQQKLSS (AS60702 + FSHβ 33-53 dual CAR with dnTGF RII amino acid sequence)
                                                                     SEQ ID NO: 418
MALPVTALLLPLALLLHAARPQVKLVESGGGSVQAGGSLRLSCAASGNVYNNMCMGWFRQAPGKEREGVASIYVGGGYTN
YADSVRGRFTISQDNAKNTLYLQMNSLKPEDTAMYCAAITVALTRAFCAPIPSRYTNWGQGTQVTVSSTTTPAPRPPTP
APTIASQPLSLRPEACRPAAGGAVHTRGLDFACDIYIWAPLAGTCGVLLLSLVITLYCKRGRKKLLYIFKQPFMRPVQTT
QEEDGCSCRFPEEEEGGCELRVKFSRSADAPAYKQGGQNQLYNELNLGRREEYDVLDKRRGRDPEMGGKPRRKNPQEGLYN
ELQKDKMAEAYSEIGMKGERRRGKGHDGLYQGLSTATKDTYDALHMQALPPRGSGATNFSLLKQAGDVEENPGPMALPVT
ALLLPLALLLHAARPYTRDLVYKDPARPKIQKTCTFTTTPAPRPPTPAPTIASQPLSLRPEACRPAAGGAVHTRGLDFAC
DIYIWAPLAGTCGVLLLSLVITLYCRSKRSRLLHSDYMNMTPRRPGPTRKHYQPYAPPRDFAAYRSRVKFSRSADAPAYK
QGGQNQLYNELNLGRREEYDVLDKRRGRDPEMGGKPRRKNPQEGLYNELQKDKMAEAYSEIGMKGERRRGKGHDGLYQGLS
TATKDTYDALHMQALPPRGSGATNFSLLKQAGDVEENPGPMGRGLLRGLWPLHIVLWTRIASTIPPHVQKSVNNDMIVTD
NNGAVKFPQLCKFCDVRFSTCDNQKSCMSNCSITSICEKPQEVCVAVWRKNDENITLETVCHDPKLPYHDFILEDAASPK
CIMKEKKKPGETFFMCSCSSDECNDNIIFSEEYNTSNPDLLLVIFQVTGISLLPPLGVAISVIIIFYCYRVNRQQKLSS (AS60676 + FSHβ 33-53 dual CAR with dnTGF RII amino acid sequence)
                                                                     SEQ ID NO: 419
MALPVTALLLPLALLLHAARPQVQLVESGGGSVQAGGSLRLSCAASGYTVSSGCMGWFRQAPGKERERVAQIGRDATTTY
ADSVKGRFTIARDDAENTLYLQMNSLKPEDTAMYSCTAYWGVYCLSPGRYWQGTQVTVSSTTTPAPRPPTPAPTIASQP
LSLRPEACRPAAGGAVHTRGLDFACDIYIWAPLAGTCGVLLLSLVITLYCKRGRKKLLYIFKQPFMRPVQTTQEEDGCSC
RFPEEEEGGCELRVKFSRSADAPAYKQGGQNQLYNELNLGRREEYDVLDKRRGRDPEMGGKPRRKNPQEGLYNELQKDKMA
EAYSEIGMKGERRRGKGHDGLYQGLSTATKDTYDALHMQALPPRGSGATNFSLLKQAGDVEENPGPMALPVTALLLPLAL
LLHAARPYTRDLVYKDPARPKIQKTCTFTTTPAPRPPTPAPTIASQPLSLRPEACRPAAGGAVHTRGLDFACDIYIWAPL
AGTCGVLLLSLVITLYCRSKRSRLLHSDYMNMTPRRPGPTRKHYQPYAPPRDFAAYRSRVKFSRSADAPAYKQGGQNQLYN
ELNLGRREEYDVLDKRRGRDPEMGGKPRRKNPQEGLYNELQKDKMAEAYSEIGMKGERRRGKGHDGLYQGLSTATKDTYD
ALHMQALPPRGSGATNFSLLKQAGDVEENPGPMGRGLLRGLWPLHIVLWTRIASTIPPHVQKSVNNDMIVTDNNGAVKFP
QLCKFCDVRFSTCDNQKSCMSNCSITSICEKPQEVCVAVWRKNDENITLETVCHDPKLPYHDFILEDAASPKCIMKEKKK
PGETFFMCSCSSDECNDNIIFSEEYNTSNPDLLLVIFQVTGISLLPPLGVAISVIIIFYCYRVNRQQKLSS (AS65233VH4)
                                                                     SEQ NO: 420
EVQLVESGGGLVQPGGSLRLSCAASEFTYSMGWFRQAPGKGLEGVSHIYTRGGTTVYADSVKGRFVLSRDNSKNTLYLQM
NSLRAEDTAVYYCAARTIFEGSWSSPSSFDFWGQGTLVTVSS (AS65233VH5)
                                                                     SEQ NO: 421
EVQLVESGGGLVQPGGSLRLSCAASEFTYSMGWFRQAPGKGLEGVAHIYTRGGTTVYADSVKGRFVLSRDNSKNTMYLQM
NSLRAEDTAMYYCAARTIFEGSWSSPSSFDFWGQGTLVTVSS (AS65233VH6)
                                                                     SEQ NO: 422
EVQLVESGGGLVQPGGSLRLSCAASEFTYSMGWFRQAPGKGREGVAHIYTRGGTTVYADSVKGRFVLSRDNSKNTMYLQM
NSLRAEDTAMYYCAARTIFEGSWSSPSSFDFWGQGTLVTVSS (AS80444VH4)
                                                                     SEQ NO: 423
EVQLVESGGGLVQPGGSLRLSCAASGFTFSRNTMGWFRQAPGKGLEGVSAIPYTSTGIVYSDSVGGRFTISRDNSKNTLY
LQMNSLRAEDTAVYYCATDRRPGTTMLAVNGYNHWGQGTLVTVSS (AS80444VH5)
                                                                     SEQ NO: 424
EVQLVESGGGLVQPGGSLRLSCAASGFTFSRNTMGWFRQAPGKGLEGVSAIPYTSTGIVYSDSVGGRFTISRDNSKNTVY
LQMNSLRAEDTAMYYCATDRRPGTTMLAVNGYNHWGQGTLVTVSS (AS80444VH6)
                                                                     SEQ NO: 425
EVQLVESGGGLVQPGGSLRLSCAASGFTFSRNTMGWFRQAPGKGREGVSAIPYTSTGIVYSDSVGGRFTISRDNSKNTVY
LQMNSLRAEDTAMYYCATDRRPGTTMLAVNGYNHWGQGTLVTVSS (AS80533VH4)
                                                                     SEQ NO: 426
QVQLVESGGGVVQPGGSLRLSCAASGLSFSTYTVAWFRQAPGKGLEGVAAIPYTSQHMVYTDSVKGRFTISRDNSKNTLY
LQMNSLRAEDTAVYYCATDRRPGTSMLAINGYNRWGQGTTVTVSS (AS80533VH5)
                                                                     SEQ NO: 427
QVQLVESGGGVVQPGGSLRLSCAASGLSFSTYTVAWFRQAPGKGLEGVAAIPYTSQHMVYTDSVKGRFTISRDNSKNTVY
LQMNSLRAEDTAMYYCATDRRPGTSMLAINGYNRWGQGTTVTVSS (AS80533VH6)
                                                                     SEQ NO: 428
QVQLVESGGGVVQPGGSLRLSCAASGLSFSTYTVAWFRQAPGKGREGVAAIPYTSQHMVYTDSVKGRFTISRDNSKNTVY
LQMNSLRAEDTAMYYCATDRRPGTSMLAINGYNRWGQGTTVTVSS
```

-continued (TC-210)

SEQ NO: 429

MQSGTHWRVLGLCLLSVGVWGQEVQLVESGGGLVQPGGSLRLSCAASGGDWSANFMYWYRQAPGKQRELVARISGRGVVD
YVESVKGRFTISRDNSKNTLYLQMNSLRAEDTAVYYCAVASYWGQGTLVTVSSGGGGSGGGGSGGGGSDGNEEMGGITQT
PYKVSISGTTVILTCPQYPGSEILWQHNDKNIGGDEDDKNIGSDEDHLSLKEFSELEQSGYYVCYPRGSKPEDANFYLYL
RARVCENCMEMDVMSVATIVIVDICITGGLLLLVYYWSKNRKAKAKPVTRGAGAGGRQRGQNKERPPPVPNPDYEPIRKG
QRDLYSGLNQRRI (CD3ε signal peptide)

SEQ NO: 430

MQSGTHWRVLGLCLLSVGVWGQ (CD3γ signal peptide)

SEQ NO: 431

MEQGKGLAVLILAIILLQGTLA (CD3δ signal peptide)

SEQ NO: 432

MEHSTFLSGLVLATLLSQVSP (CD3ε extracellular domain)

SEQ NO: 433

DGNEEMGGITQTPYKVSISGTTVILTCPQYPGSEILWQHNDKNIGGDEDDKNIGSDEDHLSLKEFSELEQSGYYVCYPRG
SKPEDANFYLYLRARVCENCMEMD (CD3γ extracellular domain)

SEQ NO: 434

QSIKGNHLVKVYDYQEDGSVLLTCDAEAKNITWFKDGKMIGFLTEDKKKWNLGSNAKDPRGMYQCKGSQNKSKPLQVYYR
MCQNCIELNAATIS (CD3δ extracellular domain)

SEQ NO: 435

FKIPIEELEDRVFVNCNTSITWVEGTVGTLLSDITRLDLGKRILDPRGIYRCNGTDIYKDKESTVQVHYRMCQSCVELDP
ATVA (CD3ε transmembrane domain)

SEQ NO: 436

VMSVATIVIVDICITGGLLLLVYYWS (CD3γ transmembrane domain)

SEQ NO: 437

GFLFAEIVSIFVLAVGVYFIA (CD3δ transmembrane domain)

SEQ NO: 438

GIIVTDVIATLLLALGVFCFA (CD3ε intracelluar domain)

SEQ NO: 439

KNRKAKAKPVTRGAGAGGRQRGQNKERPPPVPNPDYEPIRKGQRDLYSGLNQRRI (CD3γ intracelluar domain)

SEQ NO: 440

GQDGVRQSRASDKQTLLPNDQLYQPLKDREDDQYSHLQGNQLRRN (CD3δ intracelluar domain)

SEQ NO: 441

GHETGRLSGAADTQALLRNDQVYQPLRDRDDAQYSHLGGNWARNK (FSHβ 33-53 εTCR amino acid sequence)

SEQ NO: 442

MQSGTHWRVLGLCLLSVGVWGQYTRDLVYKDPARPKIQKTCTFGGGGSGGGGSGGGGSDGNEEMGGITQTPYKVSISGTT
VILTCPQYPGSEILWQHNDKNIGGDEDDKNIGSDEDHLSLKEFSELEQSGYYVCYPRGSKPEDANFYLYLRARVCENCME
MDVMSVATIVIVDICITGGLLLLVYYWSKNRKAKAKPVTRGAGAGGRQRGQNKERPPPVPNPDYEPIRKGQRDLYSGLNQ
RRI (FSHβ 33-53 γTCR amino acid sequence)

SEQ NO: 443

MEQGKGLAVLILAIILLQGTLAYTRDLVYKDPARPKIQKTCTFGGGGSGGGGSGGGGSQSIKGNHLVKVYDYQEDGSVLL
TCDAEAKNITWFKDGKMIGFLTEDKKKWNLGSNAKDPRGMYQCKGSQNKSKPLQVYYRMCQNCIELNAATISGFLFAEIV
SIFVLAVGVYFIAGQDGVRQSRASDKQTLLPNDQLYQPLKDREDDQYSHLQGNQLRRN (FSHβ 33-53 δTCR amino acid sequence)

SEQ NO: 444

MEHSTFLSGLVLATLLSQVSPYTRDLVYKDPARPKIQKTCTFGGGGSGGGGSGGGGSFKIPIEELEDRVFVNCNTSITWV
EGTVGTLLSDITRLDLGKRILDPRGIYRCNGTDIYKDKESTVQVHYRMCQSCVELDPATVAGIIVTDVIATLLLALGVFC
FAGHETGRLSGAADTQALLRNDQVYQPLRDRDDAQYSHLGGNWARNK (AS65233VH5 CAR amino acid sequence)
SEQ ID NO: 445
MALPVTALLLPLALLLHAARPEVQLVESGGGLVQPGGSLRLSCAASEFTYSMGWFRQAPGKGLEGVAHIYTRGGTTVYAD
SVKGRFVLSRDNSKNTMYLQMNSLRAEDTAMYYCAARTIFEGSWSSPSSFDFWGQGTLVTVSSTTTPAPRPPTPAPTIAS
QPLSLRPEACRPAAGGAVHTRGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMGGKPRRKNPQEGLYNELQKDK
MAEAYSEIGMKGERRRGKGHDGLYQGLSTATKDTYDALHMQALPPR (AS80444VH5 CAR amino acid sequence)
SEQ ID NO: 446
MALPVTALLLPLALLLHAARPEVQLVESGGGLVQPGGSLRLSCAASGFTFSRNTMGWFRQAPGKGLEGVSAIPYTSTGIV
YSDSVGGRFTISRDNSKNTVYLQMNSLRAEDTAMYYCATDRRPGTTMLAVNGYNHWGQGTLVTVSSTTTPAPRPPTPAPT
IASQPLSLRPEACRPAAGGAVHTRGLDFACDIYIWAPLAGTCGVLLLSLVITLYCKRGRKKLLYIFKQPFMRPVQTTQEE
DGCSCRFPEEEEGGCELRVKFSRSADAPAYKQGQNQLYNELNLGRREEYDVLDKRRGRDPEMGGKPRRKNPQEGLYNELQ
KDKMAEAYSEIGMKGERRRGKGHDGLYQGLSTATKDTYDALHMQALPPR (AS80533VH4 CAR amino acid sequence)
SEQ ID NO: 447
MALPVTALLLPLALLLHAARPQVQLVESGGGVVQPGGSLRLSCAASGLSFSTYTVAWFRQAPGKGLEGVAAIPYTSQHMV
YTDSVKGRFTISRDNSKNTLYLQMNSLRAEDTAVYYCATDRRPGTSMLAINGYNRWGQGTTVTVSSTTTPAPRPPTPAPT
IASQPLSLRPEACRPAAGGAVHTRGLDFACDIYIWAPLAGTCGVLLLSLVITLYCKRGRKKLLYIFKQPFMRPVQTTQEE
DGCSCRFPEEEEGGCELRVKFSRSADAPAYKQGQNQLYNELNLGRREEYDVLDKRRGRDPEMGGKPRRKNPQEGLYNELQ
KDKMAEAYSEIGMKGERRRGKGHDGLYQGLSTATKDTYDALHMQALPPR (FSHβ 33-53 + AS65233VH5 tandem CAR amino acid sequence)
SEQ ID NO: 448
MALPVTALLLPLALLLHAARPYTRDLVYKDPARPKIQKTCTFGGGGSGGGGSGGGGSEVQLVESGGGLVQPGGSLRLSCA
ASEFTYSMGWFRQAPGKGLEGVAHIYTRGGTTVYADSVKGRFVLSRDNSKNTMYLQMNSLRAEDTAMYYCAARTIFEGSW
SSPSSFDFWGQGTLVTVSSTTTPAPRPPTPAPTIASQPLSLRPEACRPAAGGAVHTRGLDFACDIYIWAPLAGTCGVLLL
SLVITLYCKRGRKKLLYIFKQPFMRPVQTTQEEDGCSCRFPEEEEGGCELRVKFSRSADAPAYKQGQNQLYNELNLGRRE
EYDVLDKRRGRDPEMGGKPRRKNPQEGLYNELQKDKMAEAYSEIGMKGERRRGKGHDGLYQGLSTATKDTYDALHMQALP
PR (FSHβ 33-53 + AS80444VH5 tandem CAR amino acid sequence)
SEQ ID NO: 449
MALPVTALLLPLALLLHAARPYTRDLVYKDPARPKIQKTCTFGGGGSGGGGSGGGGSEVQLVESGGGLVQPGGSLRLSCA
ASGFTFSRNTMGWFRQAPGKGLEGVSAIPYTSTGIVYSDSVGGRFTISRDNSKNTVYLQMNSLRAEDTAMYYCATDRRPG
TTMLAVNGYNHWGQGTLVTVSSTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPR (FSHβ 33-53 + AS80533VH4 tandem CAR amino acid sequence)
SEQ ID NO: 450
MALPVTALLLPLALLLHAARPYTRDLVYKDPARPKIQKTCTFGGGGSGGGGSGGGGSQVQLVESGGGVVQPGGSLRLSCA
ASGLSFSTYTVAWFRQAPGKGLEGVAAIPYTSQHMVYTDSVKGRFTISRDNSKNTLYLQMNSLRAEDTAVYYCATDRRPG
TSMLAINGYNRWGQGTTVTVSSTTTPAPRPPTPAPTIASQPLSLRPEACRPAAGGAVHTRGLDFACDIYIWAPLAGTCGV
LLLSLVITLYCKRGRKKLLYIFKQPFMRPVQTTQEEDGCSCRFPEEEEGGCELRVKFSRSADAPAYKQGQNQLYNELNLG
RREEYDVLDKRRGRDPEMGGKPRRKNPQEGLYNELQKDKMAEAYSEIGMKGERRRGKGHDGLYQGLSTATKDTYDALHMQ
ALPPR (AS65233VH5 + FSHβ 33-53 dual CAR amino acid sequence)
SEQ ID NO: 451
MALPVTALLLPLALLLHAARPEVQLVESGGGLVQPGGSLRLSCAASEFTYSMGWFRQAPGKGLEGVAHIYTRGGTTVYAD
SVKGRFVLSRDNSKNTMYLQMNSLRAEDTAMYYCAARTIFEGSWSSPSSFDFWGQGTLVTVSSTTTPAPRPPTPAPTIAS
QPLSLRPEACRPAAGGAVHTRGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMGGKPRRKNPQEGLYNELQKDK
MAEAYSEIGMKGERRRGKGHDGLYQGLSTATKDTYDALHMQALPPRGSGATNFSLLKQAGDVEENPGPMALPVTALLLPL
ALLLHAARPYTRDLVYKDPARPKIQKTCTFTTTPAPRPPTPAPTIASQPLSLRPEACRPAAGGAVHTRGLDFACDIYIWA
PLAGTCGVLLLSLVITLYCRSKRSRLLHSDYMNMTPRRPGPTRKHYQPYAPPRDFAAYRSRVKFSRSADAPAYKQGQNQL
YNELNLGRREEYDVLDKRRGRDPEMGGKPRRKNPQEGLYNELQKDKMAEAYSEIGMKGERRRGKGHDGLYQGLSTATKDT
YDALHMQALPPR (AS80444VH5 + FSHβ 33-53 dual CAR amino acid sequence)
SEQ ID NO: 452
MALPVTALLLPLALLLHAARPEVQLVESGGGLVQPGGSLRLSCAASGFTFSRNTMGWFRQAPGKGLEGVSAIPYTSTGIV
YSDSVGGRFTISRDNSKNTVYLQMNSLRAEDTAMYYCATDRRPGTTMLAVNGYNHWGQGTLVTVSSTTTPAPRPPTPAPT
IASQPLSLRPEACRPAAGGAVHTRGLDFACDIYIWAPLAGTCGVLLLSLVITLYCKRGRKKLLYIFKQPFMRPVQTTQEE
DGCSCRFPEEEEGGCELRVKFSRSADAPAYKQGQNQLYNELNLGRREEYDVLDKRRGRDPEMGGKPRRKNPQEGLYNELQ
KDKMAEAYSEIGMKGERRRGKGHDGLYQGLSTATKDTYDALHMQALPPRGSGATNFSLLKQAGDVEENPGPMALPVTALL
LPLALLLHAARPYTRDLVYKDPARPKIQKTCTFTTTPAPRPPTPAPTIASQPLSLRPEACRPAAGGAVHTRGLDFACDIY
IWAPLAGTCGVLLLSLVITLYCRSKRSRLLHSDYMNMTPRRPGPTRKHYQPYAPPRDFAAYRSRVKFSRSADAPAYKQGQ
NQLYNELNLGRREEYDVLDKRRGRDPEMGGKPRRKNPQEGLYNELQKDKMAEAYSEIGMKGERRRGKGHDGLYQGLSTAT
KDTYDALHMQALPPR (AS80533VH4 + FSHβ 33-53 dual CAR amino acid sequence)
SEQ ID NO: 453
MALPVTALLLPLALLLHAARPQVQLVESGGGVVQPGGSLRLSCAASGLSFSTYTVAWFRQAPGKGLEGVAAIPYTSQHMV
YTDSVKGRFTISRDNSKNTLYLQMNSLRAEDTAVYYCATDRRPGTSMLAINGYNRWGQGTTVTVSSTTTPAPRPPTPAPT
IASQPLSLRPEACRPAAGGAVHTRGLDFACDIYIWAPLAGTCGVLLLSLVITLYCKRGRKKLLYIFKQPFMRPVQTTQEE -continued DGCCRFPEEEEGGCELRVKFSRSADAPAYKQGQNQLYNELNLGRREEYDVLDKRRGRDPEMGGKPRRKNPQEGLYNELQ
KDKMAEAYSEIGMKGERRRGKGHDGLYQGLSTATKDTYDALHMQALPPRGSGATNFSLLKQAGDVEENPGPMALPVTALL
LPLALLLHAARPYTRDLVYKDPARPKIQKTCTFTTTPAPRPPTPAPTIASQPLSLRPEACRPAAGGAVHTRGLDFACDIY
IWAPLAGTCGVLLLSLVITLYCRSKRSRLLHSDYMNMTPRRPGPTRKHYQPYAPPRDFAAYRSRVKFSRSADAPAYKQGQ
NQLYNELNLGRREEYDVLDKRRGRDPEMGGKPRRKNPQEGLYNELQKDKMAEAYSEIGMKGERRRGKGHDGLYQGLSTAT
KDTYDALHMQALPPR (AS65233VH5 CAR + FSHβ 33-53 εTCR amino acid sequence)

SEQ ID NO: 454

MALPVTALLLPLALLLHAARPEVQLVESGGGLVQPGGSLRLSCAASEFTYSMGWFRQAPGKGLEGVAHIYTRGGTTVYAD
SVKGRFVLSRDNSKNTMYLQMNSLRAEDTAMYYCAARTIFEGSWSSPSSFDFWGQGTLVTVSSTTTTPAPRPPTPAPTIAS
QPLSLRPEACRPAAGGAVHTRGLDFACDIYIWAPLAGTCGVLLLSLVITLYCKRGRKKLLYIFKQPFMRPVQTTQEEDGC
SCRFPEEEEGGCELRVKFSRSADAPAYKQGQNQLYNELNLGRREEYDVLDKRRGRDPEMGGKPRRKNPQEGLYNELQKDK
MAEAYSEIGMKGERRRGKGHDGLYQGLSTATKDTYDALHMQALPPRGSGATNFSLLKQAGDVEENPGPMQSGTHWRVLGL
CLLSVGVWGQYTRDLVYKDPARPKIQKTCTFGGGGSGGGGSGGGGSDGNEEMGGITQTPYKVSISGTTVILTCPQYPGSE
ILWQHNDKNIGGDEDDKNIGSDEDHLSLKEFSELEQSGYYVCYPRGSKPEDANFYLYLRARVCENCMEMDVMSVATIVIV
DICITGGLLLLVYYWSKNRKAKAKPVTRGAGAGGRQRGQNKERPPPVPNPDYEPIRKGQRDLYSGLNQRRI (AS80444VH5 CAR + FSHβ 33-53 εTCR amino acid sequence)

SEQ ID NO: 455

MALPVTALLLPLALLLHAARPEVQLVESGGGLVQPGGSLRLSCAASGFTFSRNTMGWFRQAPGKGLEGVSAIPYTSTGIV
YSDSVGGRFTISRDNSKNTVYLQMNSLRAEDTAMYYCATDRRPGTTMLAVNGYNHWQGTLVTVSSTTTTPAPRPPTPAPT
IASQPLSLRPEACRPAAGGAVHTRGLDFACDIYIWAPLAGTCGVLLLSLVITLYCKRGRKKLLYIFKQPFMRPVQTTQEE
DGCSCRFPEEEEGGCELRVKFSRSADAPAYKQGQNQLYNELNLGRREEYDVLDKRRGRDPEMGGKPRRKNPQEGLYNELQ
KDKMAEAYSEIGMKGERRRGKGHDGLYQGLSTATKDTYDALHMQALPPRGSGATNFSLLKQAGDVEENPGPMQSGTHWRV
LGLCLLSVGVWGQYTRDLVYKDPARPKIQKTCTFGGGGSGGGGSGGGGSDGNEEMGGITQTPYKVSISGTTVILTCPQYP
GSEILWQHNDKNIGGDEDDKNIGSDEDHLSLKEFSELEQSGYYVCYPRGSKPEDANFYLYLRARVCENCMEMDVMSVATI
VIVDICITGGLLLLVYYWSKNRKAKAKPVTRGAGAGGRQRGQNKERPPPVPNPDYEPIRKGQRDLYSGLNQRRI (AS80533VH4 CAR + FSHβ 33-53 εTCR amino acid sequence)

SEQ ID NO: 456

MALPVTALLLPLALLLHAARPQVQLVESGGGVVQPGGSLRLSCAASGLSFSTYTVAWFRQAPGKGLEGVAAIPYTSQHMV
YTDSVKGRFTISRDNSKNTLYLQMNSLRAEDTAVYYCATDRRPGTSMLAINGYNRWQGTTVTVSSTTTTPAPRPPTPAPT
IASQPLSLRPEACRPAAGGAVHTRGLDFACDIYIWAPLAGTCGVLLLSLVITLYCKRGRKKLLYIFKQPFMRPVQTTQEE
DGCSCRFPEEEEGGCELRVKFSRSADAPAYKQGQNQLYNELNLGRREEYDVLDKRRGRDPEMGGKPRRKNPQEGLYNELQ
KDKMAEAYSEIGMKGERRRGKGHDGLYQGLSTATKDTYDALHMQALPPRGSGATNFSLLKQAGDVEENPGPMQSGTHWRV
LGLCLLSVGVWGQYTRDLVYKDPARPKIQKTCTFGGGGSGGGGSGGGGSDGNEEMGGITQTPYKVSISGTTVILTCPQYP
GSEILWQHNDKNIGGDEDDKNIGSDEDHLSLKEFSELEQSGYYVCYPRGSKPEDANFYLYLRARVCENCMEMDVMSVATI
VIVDICITGGLLLLVYYWSKNRKAKAKPVTRGAGAGGRQRGQNKERPPPVPNPDYEPIRKGQRDLYSGLNQRRI (FSHβ 33-53 εTCR with dnTGFβ RII amino acid sequence)

SEQ NO: 457

MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMQSGTHWRVLGLCLLSVGV
WGQYTRDLVYKDPARPKIQKTCTFGGGGSGGGGSGGGGSDGNEEMGGITQTPYKVSISGTTVILTCPQYPGSEILWQHND
KNIGGDEDDKNIGSDEDHLSLKEFSELEQSGYYVCYPRGSKPEDANFYLYLRARVCENCMEMDVMSVATIVIVDICITGG
LLLLVYYWSKNRKAKAKPVTRGAGAGGRQRGQNKERPPPVPNPDYEPIRKGQRDLYSGLNQRRI (FSHβ 33-53 γTCR with dnTGFβ RII amino acid sequence)

SEQ NO: 458

MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMEQGKGLAVLILAIILLQG
TLAYTRDLVYKDPARPKIQKTCTFGGGGSGGGGSGGGGSQSIKGNHLVKVYDYQEDGSVLLTCDAEAKNITWFKDGKMIG
FLTEDKKKWNLGSNAKDPRGMYQCKGSQNKSKPLQVYYRMCQNCIELNAATISGFLFAEIVSIFVLAVGVYFIAGQDGVR
QSRASDKQTLLPNDQLYQPLKDREDDQYSHLQGNQLRRN (FSHβ 33-53 δTCR with dnTGFβ RII amino acid sequence)

SEQ NO: 459

MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMEHSTFLSGLVLATLLSQV
SPYTRDLVYKDPARPKIQKTCTFGGGGSGGGGSGGGGSFKIPIEELEDRVFVNCNTSITWVEGTVGTLLSDITRLDLGKR
ILDPRGIYRCNGTDIYKDKESTVQVHYRMCQSCVELDPATVAGIIVTDVIATLLLALGVFCFAGHETGRLSGAADTQALL
RNDQVYQPLRDRDDAQYSHLGGNWARNK (AS65233VH5 CAR with dnTGFβ RII amino acid sequence)

SEQ NO: 460

MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPEVQLVESGGGLVQPGGSLRLSCAASEFTYSMGWFRQAPGKGLEGVAHIYTRGGTTVYADSVKGRFVLSRDNSKNTMYL
QMNSLRAEDTAMYYCAARTIFEGSWSSPSSFDFWGQGTLVTVSSTTTTPAPRPPTPAPTIASQPLSLRPEACRPAAGGAVH
TRGLDFACDIYIWAPLAGTCGVLLLSLVITLYCKRGRKKLLYIFKQPFMRPVQTTQEEDGCSCRFPEEEEGGCELRVKFS
RSADAPAYKQGQNQLYNELNLGRREEYDVLDKRRGRDPEMGGKPRRKNPQEGLYNELQKDKMAEAYSEIGMKGERRRGKG
HDGLYQGLSTATKDTYDALHMQALPPR

-continued (AS80444VH5 CAR with dnTGFβ RII amino acid sequence)
SEQ NO: 461
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPEVQLVESGGGLVQPGGSLRLSCAASGFTFSRNTMGWFRQAPGKGLEGVSAIPYTSTGIVYSDSVGGRFTISRDNSKNT
VYLQMNSLRAEDTAMYYCATDRRPGTTMLAVNGYNHWGQGTLVTVSSTTTPAPRPPTPAPTIASQPLSLRPEACRPAAGG
AVHTRGLDFACDIYIWAPLAGTCGVLLLSLVITLYCKRGRKKLLYIFKQPFMRPVQTTQEEDGCSCRFPEEEEGGCELRV
KFSRSADAPAYKQGQNQLYNELNLGRREEYDVLDKRRGRDPEMGGKPRRKNPQEGLYNELQKDKMAEAYSEIGMKGERRR
GKGHDGLYQGLSTATKDTYDALHMQALPPR (AS80533VH4 CAR with dnTGFβ RII amino acid sequence)
SEQ NO: 462
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPQVQLVESGGGVVQPGGSLRLSCAASGLSFSTYTVAWFRQAPGKGLEGVAAIPYTSQHMVYTDSVKGRFTISRDNSKNT
LYLQMNSLRAEDTAVYYCATDRRPGTSMLAINGYNRWGQGTTVTVSSTTTPAPRPPTPAPTIASQPLSLRPEACRPAAGG
AVHTRGLDFACDIYIWAPLAGTCGVLLLSLVITLYCKRGRKKLLYIFKQPFMRPVQTTQEEDGCSCRFPEEEEGGCELRV
KFSRSADAPAYKQGQNQLYNELNLGRREEYDVLDKRRGRDPEMGGKPRRKNPQEGLYNELQKDKMAEAYSEIGMKGERRR
GKGHDGLYQGLSTATKDTYDALHMQALPPR (FSHβ 33-53 + AS65233VH5 tandem CAR with dnTGFβ RII amino acid sequence)
SEQ ID NO: 463
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPYTRDLVYKDPARPKIQKTCTFGGGGSGGGGSGGGGSEVQLVESGGGLVQPGGSLRLSCAASEFTYSMGWFRQAPGKGL
EGVAHIYTRGGTTVYADSVKGRFVLSRDNSKNTMYLQMNSLRAEDTAMYYCAARTIFEGSWSSPSSFDFWGQGTLVTVSS
TTTPAPRPPTPAPTIASQPLSLRPEACRPAAGGAVHTRGLDFACDIYIWAPLAGTCGVLLLSLVITLYCKRGRKKLLYIF
KQPFMRPVQTTQEEDGCSCRFPEEEEGGCELRVKFSRSADAPAYKQGQNQLYNELNLGRREEYDVLDKRRGRDPEMGGKP
RRKNPQEGLYNELQKDKMAEAYSEIGMKGERRRGKGHDGLYQGLSTATKDTYDALHMQALPPR (FSHβ 33-53 + AS80444VH5 tandem CAR with dnTGFβ RII amino acid sequence)
SEQ ID NO: 464
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPYTRDLVYKDPARPKIQKTCTFGGGGSGGGGSGGGGSEVQLVESGGGLVQPGGSLRLSCAASGFTFSRNTMGWFRQAPG
KGLEGVSAIPYTSTGIVYSDSVGGRFTISRDNSKNTVYLQMNSLRAEDTAMYYCATDRRPGTTMLAVNGYNHWGQGTLVT
VSSTTTPAPRPPTPAPTIASQPLSLRPEACRPAAGGAVHTRGLDFACDIYIWAPLAGTCGVLLLSLVITLYCKRGRKKLL
YIFKQPFMRPVQTTQEEDGCSCRFPEEEEGGCELRVKFSRSADAPAYKQGQNQLYNELNLGRREEYDVLDKRRGRDPEMG
GKPRRKNPQEGLYNELQKDKMAEAYSEIGMKGERRRGKGHDGLYQGLSTATKDTYDALHMQALPPR (FSHβ 33-53 + AS80533VH4 tandem CAR with dnTGFβ RII amino acid sequence)
SEQ ID NO: 465
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPYTRDLVYKDPARPKIQKTCTFGGGGSGGGGSGGGGSQVQLVESGGGVVQPGGSLRLSCAASGLSFSTYTVAWFRQAPG
KGLEGVAAIPYTSQHMVYTDSVKGRFTISRDNSKNTLYLQMNSLRAEDTAVYYCATDRRPGTSMLAINGYNRWGQGTTVT
VSSTTTPAPRPPTPAPTIASQPLSLRPEACRPAAGGAVHTRGLDFACDIYIWAPLAGTCGVLLLSLVITLYCKRGRKKLL
YIFKQPFMRPVQTTQEEDGCSCRFPEEEEGGCELRVKFSRSADAPAYKQGQNQLYNELNLGRREEYDVLDKRRGRDPEMG
GKPRRKNPQEGLYNELQKDKMAEAYSEIGMKGERRRGKGHDGLYQGLSTATKDTYDALHMQALPPR (AS65233VH5 + FSHβ 33-53 dual CAR with dnTGFβ RII amino acid sequence)
SEQ ID NO: 466
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPEVQLVESGGGLVQPGGSLRLSCAASEFTYSMGWFRQAPGKGLEGVAHIYTRGGTTVYADSVKGRFVLSRDNSKNTMYL
QMNSLRAEDTAMYYCAARTIFEGSWSSPSSFDFWGQGTLVTVSSTTTPAPRPPTPAPTIASQPLSLRPEACRPAAGGAVH
TRGLDFACDIYIWAPLAGTCGVLLLSLVITLYCKRGRKKLLYIFKQPFMRPVQTTQEEDGCSCRFPEEEEGGCELRVKFS
RSADAPAYKQGQNQLYNELNLGRREEYDVLDKRRGRDPEMGGKPRRKNPQEGLYNELQKDKMAEAYSEIGMKGERRRGKG
HDGLYQGLSTATKDTYDALHMQALPPRGSATNFSLLKQAGDVEENPGPMALPVTALLLPLALLLHAARPYTRDLVYKDP
ARPKIQKTCTFTTTPAPRPPTPAPTIASQPLSLRPEACRPAAGGAVHTRGLDFACDIYIWAPLAGTCGVLLLSLVITLYC
RSKRSRLLHSDYMNMTPRRPGPTRKHYQPYAPPRDFAAYRSRVKFSRSADAPAYKQGQNQLYNELNLGRREEYDVLDKRR
GRDPEMGGKPRRKNPQEGLYNELQKDKMAEAYSEIGMKGERRRGKGHDGLYQGLSTATKDTYDALHMQALPPR -continued (AS80444VH5 + FSHβ 33-53 dual CAR with dnTGFβ RII amino acid sequence)
SEQ ID NO: 467
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPEVQLVESGGGLVQPGGSLRLSCAASGFTFSRNTMGWFRQAPGKGLEGVSAIPYTSTGIVYSDSVGGRFTISRDNSKNT
VYLQMNSLRAEDTAMYYCATDRRPGTTMLAVNGYNHWGQGTLVTVSSTTTPAPRPPTPAPTIASQPLSLRPEACRPAAGG
AVHTRGLDFACDIYIWAPLAGTCGVLLLSLVITLYCKRGRKKLLYIFKQPFMRPVQTTQEEDGCSCRFPEEEEGGCELRV
KFSRSADAPAYKQGQNQLYNELNLGRREEYDVLDKRRGRDPEMGGKPRRKNPQEGLYNELQKDKMAEAYSEIGMKGERRR
GKGHDGLYQGLSTATKDTYDALHMQALPPRGSGATNFSLLKQAGDVEENPGPMALPVTALLLPLALLLHAARPYTRDLVY
KDPARPKIQKTCTFTTTPAPRPPTPAPTIASQPLSLRPEACRPAAGGAVHTRGLDFACDIYIWAPLAGTCGVLLLSLVIT
LYCRSKRSRLLHSDYMNMTPRRPGPTRKHYQPYAPPRDFAAYRSRVKFSRSADAPAYKQGQNQLYNELNLGRREEYDVLD
KRRGRDPEMGGKPRRKNPQEGLYNELQKDKMAEAYSEIGMKGERRRGKGHDGLYQGLSTATKDTYDALHMQALPPR (AS80533VH4 + FSHβ 33-53 dual CAR with dnTGFβ RII amino acid sequence)
SEQ ID NO: 468
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPQVQLVESGGGVVQPGGSLRLSCAASGLSFSTYTVAWFRQAPGKGLEGVAAIPYTSQHMVYTDSVKGRFTISRDNSKNT
LYLQMNSLRAEDTAVYYCATDRRPGTSMLAINGYNRWGQGTTVTVSSTTTPAPRPPTPAPTIASQPLSLRPEACRPAAGG
AVHTRGLDFACDIYIWAPLAGTCGVLLLSLVITLYCKRGRKKLLYIFKQPFMRPVQTTQEEDGCSCRFPEEEEGGCELRV
KFSRSADAPAYKQGQNQLYNELNLGRREEYDVLDKRRGRDPEMGGKPRRKNPQEGLYNELQKDKMAEAYSEIGMKGERRR
GKGHDGLYQGLSTATKDTYDALHMQALPPRGSGATNFSLLKQAGDVEENPGPMALPVTALLLPLALLLHAARPYTRDLVY
KDPARPKIQKTCTFTTTPAPRPPTPAPTIASQPLSLRPEACRPAAGGAVHTRGLDFACDIYIWAPLAGTCGVLLLSLVIT
LYCRSKRSRLLHSDYMNMTPRRPGPTRKHYQPYAPPRDFAAYRSRVKFSRSADAPAYKQGQNQLYNELNLGRREEYDVLD
KRRGRDPEMGGKPRRKNPQEGLYNELQKDKMAEAYSEIGMKGERRRGKGHDGLYQGLSTATKDTYDALHMQALPPR (AS65233VH5 CAR + FSHβ 33-53 εTCR with dnTGFβ RII amino acid sequence)
SEQ ID NO: 469
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPEVQLVESGGGLVQPGGSLRLSCAASEFTYSMGWFRQAPGKGLEGVAHIYTRGGTTVYADSVKGRFVLSRDNSKNTMYL
QMNSLRAEDTAMYYCAARTIFEGSWSSPSSFDFWGQGTLVTVSSTTTPAPRPPTPAPTIASQPLSLRPEACRPAAGGAVH
TRGLDFACDIYIWAPLAGTCGVLLLSLVITLYCKRGRKKLLYIFKQPFMRPVQTTQEEDGCSCRFPEEEEGGCELRVKFS
RSADAPAYKQGQNQLYNELNLGRREEYDVLDKRRGRDPEMGGKPRRKNPQEGLYNELQKDKMAEAYSEIGMKGERRRGKG
HDGLYQGLSTATKDTYDALHMQALPPRGSGATNFSLLKQAGDVEENPGPMQSGTHWRVLGLCLLSVGVWGQYTRDLVYKD
PARPKIQKTCTFGGGGSGGGGSGGGGSDGNEEMGGITQTPYKVSISGTTVILTCPQYPGSEILWQHNDKNIGGDEDDKNI
GSDEDHLSLKEFSELEQSGYYVCYPRGSKPEDANFYLYLRARVCENCMEMDVMSVATIVIVDICITGGLLLLVYYWSKNR
KAKAKPVTRGAGAGGRQRGQNKERPPPVPNPDYEPIRKGQRDLYSGLNQRRI (AS80444VH5 CAR + FSHβ 33-53 εTCR with dnTGFβ RII amino acid sequence)
SEQ ID NO: 470
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPEVQLVESGGGLVQPGGSLRLSCAASGFTFSRNTMGWFRQAPGKGLEGVSAIPYTSTGIVYSDSVGGRFTISRDNSKNT
VYLQMNSLRAEDTAMYYCATDRRPGTTMLAVNGYNHWGQGTLVTVSSTTTPAPRPPTPAPTIASQPLSLRPEACRPAAGG
AVHTRGLDFACDIYIWAPLAGTCGVLLLSLVITLYCKRGRKKLLYIFKQPFMRPVQTTQEEDGCSCRFPEEEEGGCELRV
KFSRSADAPAYKQGQNQLYNELNLGRREEYDVLDKRRGRDP EMGGKPRRKNPQEGLYNELQKDKMAEAYSEIGMKGERRR
GKGHDGLYQGLSTATKDTYDALHMQALPPRGSGATNFSLLKQAGDVEENPGPMQSGTHWRVLGLCLLSVGVWGQYTRDLV
YKDPARPKIQKTCTFGGGGSGGGGSGGGGSDGNEEMGGITQTPYKVSISGTTVILTCPQYPGSEILWQHNDKNIGGDEDD
KNIGSDEDHLSLKEFSELEQSGYYVCYPRGSKPEDANFYLYLRARVCENCMEMDVMSVATIVIVDICITGGLLLLVYYWS
KNRKAKAKPVTRGAGAGGRQRGQNKERPPPVPNPDYEPIRKGQRDLYSGLNQRRI (AS80533VH4 CAR + FSHβ 33-53 εTCR with dnTGFβ RII amino acid sequence)
SEQ ID NO: 471
MGRGLLRGLWPLHIVLWTRIASTIPPHVQKSVNNDMIVTDNNGAVKFPQLCKFCDVRFSTCDNQKSCMSNCSITSICEKP
QEVCVAVWRKNDENITLETVCHDPKLPYHDFILEDAASPKCIMKEKKKPGETFFMCSCSSDECNDNIIFSEEYNTSNPDL
LLVIFQVTGISLLPPLGVAISVIIIFYCYRVNRQQKLSSGSGATNFSLLKQAGDVEENPGPMALPVTALLLPLALLLHAA
RPQVQLVESGGGVVQPGGSLRLSCAASGLSFSTYTVAWFRQAPGKGLEGVAAIPYTSQHMVYTDSVKGRFTISRDNSKNT
LYLQMNSLRAEDTAVYYCATDRRPGTSMLAINGYNRWGQGTTVTVSSTTTPAPRPPTPAPTIASQPLSLRPEACRPAAGG
AVHTRGLDFACDIYIWAPLAGTCGVLLLSLVITLYCKRGRKKLLYIFKQPFMRPVQTTQEEDGCSCRFPEEEEGGCELRV
KFSRSADAPAYKQGQNQLYNELNLGRREEYDVLDKRRGRDPEMGGKPRRKNPQEGLYNELQKDKMAEAYSEIGMKGERRR
GKGHDGLYQGLSTATKDTYDALHMQALPPRGSGATNFSLLKQAGDVEENPGPMQSGTHWRVLGLCLLSVGVWGQYTRDLV
YKDPARPKIQKTCTFGGGGSGGGGSGGGGSDGNEEMGGITQTPYKVSISGTTVILTCPQYPGSEILWQHNDKNIGGDEDD
KNIGSDEDHLSLKEFSELEQSGYYVCYPRGSKPEDANFYLYLRARVCENCMEMDVMSVATIVIVDICITGGLLLLVYYWS
KNRKAKAKPVTRGAGAGGRQRGQNKERPPPVPNPDYEPIRKGQRDLYSGLNQRRI

SEQUENCE LISTING (471 sequences)

SEQ ID NO: 1 - protein, 10 aa, Artificial Sequence
  AD58126-VH CDR1
GYTFTSYWMH

SEQ ID NO: 2 - protein, 17 aa, Artificial Sequence
  AD58126-VL CDR1
KSSQSLLNSGNQKNYLT

SEQ ID NO: 3 - protein, 10 aa, Artificial Sequence
  AD58116-VH CDR1
GYTFTEYTMN

SEQ ID NO: 4 - protein, 16 aa, Artificial Sequence
  AD58116-VL CDR1
KSSQSLLDSDGKTYLN

SEQ ID NO: 5 - protein, 10 aa, Artificial Sequence
  AD58117-VH CDR1
FYTFTAYSMH

SEQ ID NO: 6 - protein, 15 aa, Artificial Sequence
  AD58117-VL CDR1
RASESVDSYGNSFMN

SEQ ID NO: 7 - protein, 10 aa, Artificial Sequence
  AD58127-VH CDR1
GYTFTDYEIH

SEQ ID NO: 8 - protein, 16 aa, Artificial Sequence
  AD58127-VL CDR1
RSSQSLVHSNGNTYLH

SEQ ID NO: 9 - protein, 10 aa, Artificial Sequence
  AD58143-VH CDR1
GYTFTDYEMH

SEQ ID NO: 10 - protein, 16 aa, Artificial Sequence
  AD58143-VL CDR1
RSSQSLVHSNGNTYLH

SEQ ID NO: 11 - protein, 10 aa, Artificial Sequence
  AD58159-VH CDR1
GYTITNYWLG

SEQ ID NO: 12 - protein, 11 aa, Artificial Sequence
  AD58159-VL CDR1
SASQDISNYLN

SEQ ID NO: 13 - protein, 10 aa, Artificial Sequence
  AD58115-VH CDR1
GYTFTEYTMN

SEQ ID NO: 14 - protein, 16 aa, Artificial Sequence
  AD58115-VL CDR1
KSSQSLLDSDGKTYLN

SEQ ID NO: 15 - protein, 10 aa, Artificial Sequence
  AD58123-VH CDR1
GFSLSRYSVH

SEQ ID NO: 16 - protein, 17 aa, Artificial Sequence
  AD58123-VL CDR1
KSSQSVLYSSNQKNYLA

SEQ ID NO: 17 - protein, 10 aa, Artificial Sequence
  AD58145-VH CDR1
GYTFTSYWMH

SEQ ID NO: 18 - protein, 17 aa, Artificial Sequence
  AD58145-VL CDR1
KSSQSLLNSGNQKNYLT

SEQ ID NO: 19 - protein, 10 aa, Artificial Sequence
  AS51489-VH CDR1
GFNLYYYSIH

SEQ ID NO: 20 - protein, 11 aa, Artificial Sequence
  AS51489-VL CDR1
RASQSVSSAVA

SEQ ID NO: 21 - protein, 10 aa, Artificial Sequence
  AS51491-VH CDR1
GFNLYSYSMH

SEQ ID NO: 22 - protein, 11 aa, Artificial Sequence
  AS51491-VL CDR1
RASQSVSSAVA

SEQ ID NO: 23 - protein, 10 aa, Artificial Sequence
  AS92110-VH CDR1
GFNIYYSSMH

SEQ ID NO: 24 - protein, 11 aa, Artificial Sequence
  AS92110-VL CDR1
RASQSVSSAVA

SEQ ID NO: 25 - protein, 10 aa, Artificial Sequence
  AS91156-VH CDR1
GFNIYSSSIH

SEQ ID NO: 26 - protein, 11 aa, Artificial Sequence
  AS91156-VL CDR1
RASQSVSSAVA

SEQ ID NO: 27 - protein, 10 aa, Artificial Sequence
  AS91189-VH CDR1
GFNLSYSSIH

SEQ ID NO: 28 - protein, 11 aa, Artificial Sequence
  AS91189-VL CDR1
RASQSVSSAVA

SEQ ID NO: 29 - protein, 10 aa, Artificial Sequence
  AS51674-VH CDR1
GFNLYSYYMH

SEQ ID NO: 30 - protein, 11 aa, Artificial Sequence
  AS51674-VL CDR1
RASQSVSSAVA

SEQ ID NO: 31 - protein, 9 aa, Artificial Sequence
  AS66073 CDR1
KYSSLYCMA

SEQ ID NO: 32 - protein, 10 aa, Artificial Sequence
  AS66439 CDR1
GFTSSDCDMD

SEQ ID NO: 33 - protein, 10 aa, Artificial Sequence
  AS65955 CDR1
GDRVSTGCMG

SEQ ID NO: 34 - protein, 7 aa, Artificial Sequence
  AS65233 CDR1
EFTYSMG

SEQ ID NO: 35 - protein, 10 aa, Artificial Sequence
  AS65926 CDR1
GNLYNNMCMG

SEQ ID NO: 36 - protein, 10 aa, Artificial Sequence
  AS66159 CDR1
GNVYNNMCMG

SEQ ID NO: 37 - protein, 10 aa, Artificial Sequence
  AS66416 CDR1
GNLYNNMCMG

SEQ ID NO: 38 - protein, 10 aa, Artificial Sequence
  AS65850 CDR1
GFSYSNICMG

SEQ ID NO: 39 - protein, 11 aa, Artificial Sequence
  AS65183 CDR1
NGYYNRRYCMA

SEQ ID NO: 40 - protein, 10 aa, Artificial Sequence
  AS65062 CDR1
GVSVVNFAMR

SEQ ID NO: 41 - protein, 10 aa, Artificial Sequence
  AS65065 CDR1
GYSYCRSTMR

SEQ ID NO: 42 - protein, 10 aa, Artificial Sequence
  AS65556 CDR1
GYNASICRMS

SEQ ID NO: 43 - protein, 10 aa, Artificial Sequence
  AS65069 CDR1
GDTGYQPTMR

SEQ ID NO: 44 - protein, 10 aa, Artificial Sequence
  AS65691 CDR1
GYTDYRLVLR

SEQ ID NO: 45 - protein, 10 aa, Artificial Sequence
  AS65064 CDR1
GDTVQTNCMA

SEQ ID NO: 46 - protein, 10 aa, Artificial Sequence
  AS65081 CDR1
GVPASSYCMG

SEQ ID NO: 47 - protein, 8 aa, Artificial Sequence
  AS65115 CDR1
GYIYGCMG

SEQ ID NO: 48 - protein, 9 aa, Artificial Sequence
  AS65271 CDR1
GKTYGRCMA

SEQ ID NO: 49 - protein, 12 aa, Artificial Sequence
  AS65166 CDR1
EDLSIYGYNCMG

SEQ ID NO: 50 - protein, 10 aa, Artificial Sequence
  AS65450 CDR1
GDMNGYKCMG

SEQ ID NO: 51 - protein, 10 aa, Artificial Sequence
  AS65454 CDR1
GDMNGYKCMG

SEQ ID NO: 52 - protein, 7 aa, Artificial Sequence
  AS65131 CDR1
EYVTHLG

SEQ ID NO: 53 - protein, 10 aa, Artificial Sequence
  AS65182 CDR1
GYTYSYGYMG

SEQ ID NO: 54 - protein, 10 aa, Artificial Sequence
  AS60685 CDR1
GNVYNNMCMG

SEQ ID NO: 55 - protein, 10 aa, Artificial Sequence
  AS60702 CDR1
GNVYNNMCMG

SEQ ID NO: 56 - protein, 11 aa, Artificial Sequence
  AS60705 CDR1
GYAYSGSCMMA

SEQ ID NO: 57 - protein, 10 aa, Artificial Sequence
  AS60660 CDR1
GDTGYQPTMR

SEQ ID NO: 58 - protein, 10 aa, Artificial Sequence
  AS60662 CDR1
GYRNCRSTMR

SEQ ID NO: 59 - protein, 9 aa, Artificial Sequence
  AS60664 CDR1
GKTYGRCMA

SEQ ID NO: 60 - protein, 10 aa, Artificial Sequence
  AS60668 CDR1
GDMNGYKCMG

SEQ ID NO: 61 - protein, 10 aa, Artificial Sequence
  AS60676 CDR1
GYTVSSGCMG

SEQ ID NO: 62 - protein, 10 aa, Artificial Sequence
  AS60678 CDR1
GYTSSRGCMS

SEQ ID NO: 63 - protein, 10 aa, Artificial Sequence
  AS60679 CDR1
GVTYCRLTMR

SEQ ID NO: 64 - protein, 7 aa, Artificial Sequence
  AS81326 CDR1
ESRDCMA

SEQ ID NO: 65 - protein, 13 aa, Artificial Sequence
  AS81187 CDR1
GYTYSSYSSNCLG

SEQ ID NO: 66 - protein, 10 aa, Artificial Sequence
  AS80533 CDR1
GLSFSTYTVA

SEQ ID NO: 67 - protein, 10 aa, Artificial Sequence
  AS80444 CDR1
GFTFSRNTMG

SEQ ID NO: 68 - protein, 10 aa, Artificial Sequence
  AS81487 CDR1
KLTAWRSCVG

SEQ ID NO: 69 - protein, 17 aa, Artificial Sequence
  AD58126-VH CDR2
YINPSTGHTDYNQKFKD

SEQ ID NO: 70 - protein, 7 aa, Artificial Sequence
  AD58126-VL CDR2
WASTRES

SEQ ID NO: 71 - protein, 17 aa, Artificial Sequence
  AD58116-VH CDR2
GIIPNNGDTSYNQKFKG

SEQ ID NO: 72 - protein, 7 aa, Artificial Sequence
  AD58116-VL CDR2
LVSKLDS

SEQ ID NO: 73 - protein, 17 aa, Artificial Sequence
  AD58117-VH CDR2
WINTETGEPTYADDFKG

SEQ ID NO: 74 - protein, 7 aa, Artificial Sequence
  AD58117-VL CDR2
LASYLES

SEQ ID NO: 75 - protein, 17 aa, Artificial Sequence
  AD58127-VH CDR2
GIDPETGGAAYTQKFKG

SEQ ID NO: 76 - protein, 7 aa, Artificial Sequence
  AD58127-VL CDR2
KVSNRFS

SEQ ID NO: 77 - protein, 17 aa, Artificial Sequence
  AD58143-VH CDR2
GIDPETGGAAYTQKFKG

SEQ ID NO: 78 - protein, 7 aa, Artificial Sequence
  AD58143-VL CDR2
KVSNRFS

SEQ ID NO: 79 - protein, 17 aa, Artificial Sequence
  AD58159-VH CDR2
DIYPGGGYTNYNEKFKG

SEQ ID NO: 80 - protein, 7 aa, Artificial Sequence
  AD58159-VL CDR2
YTSSLHS

SEQ ID NO: 81 - protein, 17 aa, Artificial Sequence
  AD58115-VH CDR2
GIIPNNGDTSYKQEFKG

SEQ ID NO: 82 - protein, 7 aa, Artificial Sequence
  AD58115-VL CDR2
LVSKLDS

SEQ ID NO: 83 - protein, 16 aa, Artificial Sequence
  AD58123-VH CDR2
MIWGGGNTDYNSALKS

SEQ ID NO: 84 - protein, 7 aa, Artificial Sequence
  AD58123-VL CDR2
WASTRES

SEQ ID NO: 85 - protein, 17 aa, Artificial Sequence
  AD58145-VH CDR2
YINPSTGYTDYNQKFKD

SEQ ID NO: 86 - protein, 7 aa, Artificial Sequence
  AD58145-VL CDR2
WASTRES

SEQ ID NO: 87 - protein, 17 aa, Artificial Sequence
  AS51489-VH CDR2
YISSSSSYTYYADSVKG

SEQ ID NO: 88 - protein, 7 aa, Artificial Sequence
  AS51489-VL CDR2
SASSLYS

SEQ ID NO: 89 - protein, 17 aa, Artificial Sequence
  AS51491-VH CDR2
YIYPYSGSTYYADSVKG

SEQ ID NO: 90 - protein, 7 aa, Artificial Sequence
  AS51491-VL CDR2
SASSLYS

SEQ ID NO: 91 - protein, 17 aa, Artificial Sequence
  AS92110-VH CDR2
YIYPYYSYTYYADSVKG

SEQ ID NO: 92 - protein, 7 aa, Artificial Sequence
  AS92110-VL CDR2
SASSLYS

SEQ ID NO: 93 - protein, 17 aa, Artificial Sequence
  AS91156-VH CDR2
SISSYSSYTSYADSVKG

SEQ ID NO: 94 - protein, 7 aa, Artificial Sequence
  AS91156-VL CDR2
SASSLYS

SEQ ID NO: 95 - protein, 17 aa, Artificial Sequence
  AS91189-VH CDR2
SIYSYSGSTYYADSVKG

SEQ ID NO: 96 - protein, 7 aa, Artificial Sequence
  AS91189-VL CDR2
SASSLYS

SEQ ID NO: 97 - protein, 17 aa, Artificial Sequence
  AS51674-VH CDR2
SIYSYSSYTSYADSVKG

SEQ ID NO: 98 - protein, 7 aa, Artificial Sequence
  AS51674-VL CDR2
SASSLYS

SEQ ID NO: 99 - protein, 16 aa, Artificial Sequence
  AS66073 CDR2
VISSGGFTNYADSVKG

SEQ ID NO: 100 - protein, 17 aa, Artificial Sequence
  AS66439 CDR2
SLLSTDGSTSYADSVRG

SEQ ID NO: 101 - protein, 16 aa, Artificial Sequence
  AS65955 CDR2
QIHNYNIAKYADSVKG

SEQ ID NO: 102 - protein, 17 aa, Artificial Sequence
  AS65233 CDR2
HIYTRGGTTVYADSVKG

SEQ ID NO: 103 - protein, 17 aa, Artificial Sequence
  AS65926 CDR2
SIYIGGGYTNYADSVKG

SEQ ID NO: 104 - protein, 17 aa, Artificial Sequence
  AS66159 CDR2
SIYVGGGYTNYADSVRG

SEQ ID NO: 105 - protein, 17 aa, Artificial Sequence
  AS66416 CDR2
SIYIGGGYTNYSESVRG

SEQ ID NO: 106 - protein, 16 aa, Artificial Sequence
  AS65850 CDR2
AIYSNGSTIYADSVKG

SEQ ID NO: 107 - protein, 17 aa, Artificial Sequence
  AS65183 CDR2
TMTTTSGRTYYADAVKG

SEQ ID NO: 108 - protein, 16 aa, Artificial Sequence
  AS65062 CDR2
AMYRSGSTSYADSVRG

SEQ ID NO: 109 - protein, 16 aa, Artificial Sequence
  AS65065 CDR2
AIYSDGTTSYTDSVKG

SEQ ID NO: 110 - protein, 16 aa, Artificial Sequence
  AS65556 CDR2
SSYRDGSQSYADSVKG

SEQ ID NO: 111 - protein, 16 aa, Artificial Sequence
  AS65069 CDR2
AIYSDQTTSYADSVKG

SEQ ID NO: 112 - protein, 16 aa, Artificial Sequence
  AS65691 CDR2
AIYSDGVTSYSDSVKG

SEQ ID NO: 113 - protein, 20 aa, Artificial Sequence
  AS65064 CDR2
SILSLYSSGGKTVYADSVKG

SEQ ID NO: 114 - protein, 16 aa, Artificial Sequence
  AS65081 CDR2
GIVSDTTTTYADSVKG

SEQ ID NO: 115 - protein, 16 aa, Artificial Sequence
  AS65115 CDR2
TIYRDGTAYYANSVEG

SEQ ID NO: 116 - protein, 17 aa, Artificial Sequence
  AS65271 CDR2
ATYISGGRPYVADSVKG

SEQ ID NO: 117 - protein, 17 aa, Artificial Sequence
  AS65166 CDR2
AIYTGRGTTYYADSVKG

SEQ ID NO: 118 - protein, 17 aa, Artificial Sequence
  AS65450 CDR2
GIYTGRGTTYYADSVKD

SEQ ID NO: 119 - protein, 17 aa, Artificial Sequence
  AS65454 CDR2
GIYTGRNTTYYADSVKD

SEQ ID NO: 120 - protein, 17 aa, Artificial Sequence
  AS65131 CDR2
IESFRIGYTYYADSVKG

SEQ ID NO: 121 - protein, 17 aa, Artificial Sequence
  AS65182 CDR2
KIYNGDGSTYYADSVKG

SEQ ID NO: 122 - protein, 17 aa, Artificial Sequence
  AS60685 CDR2
SMYVGGGYTYYDDSVKG

SEQ ID NO: 123 - protein, 17 aa, Artificial Sequence
  AS60702 CDR2
SIYVGGGYTNYADSVRG

SEQ ID NO: 124 - protein, 17 aa, Artificial Sequence
  AS60705 CDR2
VSVRRTGSAFYADSVKA

SEQ ID NO: 125 - protein, 16 aa, Artificial Sequence
  AS60660 CDR2
AIYSDQTTSYADSVKG

SEQ ID NO: 126 - protein, 16 aa, Artificial Sequence
  AS60662 CDR2
SIYTDGTTSYTDSVKG

SEQ ID NO: 127 - protein, 17 aa, Artificial Sequence
  AS60664 CDR2
ATYISGGRPYVADSVKG

SEQ ID NO: 128 - protein, 17 aa, Artificial Sequence
  AS60668 CDR2
GIYTGRNTTYYADSVKD

SEQ ID NO: 129 - protein, 16 aa, Artificial Sequence
  AS60676 CDR2
QIGRDATTTYADSVKG

SEQ ID NO: 130 - protein, 17 aa, Artificial Sequence
  AS60678 CDR2
YINMRVLTTIYAASVKD

SEQ ID NO: 131 - protein, 16 aa, Artificial Sequence
  AS60679 CDR2
AIYSDGSTAYADSVKG

SEQ ID NO: 132 - protein, 17 aa, Artificial Sequence
  AS81326 CDR2
SIYAPDGSTTYADTVKG

SEQ ID NO: 133 - protein, 17 aa, Artificial Sequence
  AS81187 CDR2
RIYPNSGSTYYADSVKG

SEQ ID NO: 134 - protein, 17 aa, Artificial Sequence
  AS80533 CDR2
AIPYTSQHMVYTDSVKG

SEQ ID NO: 135 - protein, 17 aa, Artificial Sequence
  AS80444 CDR2
AIPYTSTGIVYSDSVGG

SEQ ID NO: 136 - protein, 17 aa, Artificial Sequence
  AS81487 CDR2
AIYSGTGSTYYADSVKG

SEQ ID NO: 137 - protein, 8 aa, Artificial Sequence
  AD58126-VH CDR3
SNWAWFPY

SEQ ID NO: 138 - protein, 9 aa, Artificial Sequence
  AD58126-VL CDR3
QNDYSYPLT

SEQ ID NO: 139 - protein, 4 aa, Artificial Sequence
  AD58116-VH CDR3
RFAY

SEQ ID NO: 140 - protein, 9 aa, Artificial Sequence
  AD58116-VL CDR3
WQGTHFPFT

SEQ ID NO: 141 - protein, 7 aa, Artificial Sequence
  AD58117-VH CDR3
GLRRFAY

SEQ ID NO: 142 - protein, 9 aa, Artificial Sequence
  AD58117-VL CDR3
QQNNEDPYT

SEQ ID NO: 143 - protein, 8 aa, Artificial Sequence
  AD58127-VH CDR3
YGNYPLDS

SEQ ID NO: 144 - protein, 9 aa, Artificial Sequence
  AD58127-VL CDR3
SQSTHVPLT

SEQ ID NO: 145 - protein, 8 aa, Artificial Sequence
  AD58143-VH CDR3
YGNYPLDS

SEQ ID NO: 146 - protein, 9 aa, Artificial Sequence
  AD58143-VL CDR3
SQSTHVPLT

SEQ ID NO: 147 - protein, 10 aa, Artificial Sequence
  AD58159-VH CDR3
GGSSYWYFDV

SEQ ID NO: 148 - protein, 9 aa, Artificial Sequence
  AD58159-VL CDR3
QQYSKVPYT

SEQ ID NO: 149 - protein, 4 aa, Artificial Sequence
  AD58115-VH CDR3
RFAY

SEQ ID NO: 150 - protein, 9 aa, Artificial Sequence
  AD58115-VL CDR3
WQGTHFPFT

SEQ ID NO: 151 - protein, 8 aa, Artificial Sequence
  AD58123-VH CDR3
SLGWYFDI

SEQ ID NO: 152 - protein, 8 aa, Artificial Sequence
  AD58123-VL CDR3
HQYLSSWT

SEQ ID NO: 153 - protein, 8 aa, Artificial Sequence
  AD58145-VH CDR3
SNWAWFPY

SEQ ID NO: 154 - protein, 9 aa, Artificial Sequence
  AD58145-VL CDR3
QNDYSYPLT

SEQ ID NO: 155 - protein, 9 aa, Artificial Sequence
  AS51489-VH CDR3
YYPYYGMDY

SEQ ID NO: 156 - protein, 10 aa, Artificial Sequence
  AS51489-VL CDR3
QQGFSYYPIT

SEQ ID NO: 157 - protein, 6 aa, Artificial Sequence
  AS51491-VH CDR3
GYGMDY

SEQ ID NO: 158 - protein, 9 aa, Artificial Sequence
  AS51491-VL CDR3
QQSYYWLFT

SEQ ID NO: 159 - protein, 6 aa, Artificial Sequence
  AS92110-VH CDR3
GYALDY

SEQ ID NO: 160 - protein, 12 aa, Artificial Sequence
  AS92110-VL CDR3
QQASSGYHYLIT

SEQ ID NO: 161 - protein, 6 aa, Artificial Sequence
  AS91156-VH CDR3
YYAMDY

SEQ ID NO: 162 - protein, 10 aa, Artificial Sequence
  AS91156-VL CDR3
QQGPYYHPIT

SEQ ID NO: 163 - protein, 6 aa, Artificial Sequence
  AS91189-VH CDR3
YWGMDY

SEQ ID NO: 164 - protein, 10 aa, Artificial Sequence
  AS91189-VL CDR3
QQYYWYYPIT

SEQ ID NO: 165 - protein, 11 aa, Artificial Sequence
  AS51674-VH CDR3
PFGWGYAGMDY

SEQ ID NO: 166 - protein, 8 aa, Artificial Sequence
  AS51674-VL CDR3
QQGYAPIT

SEQ ID NO: 167 - protein, 14 aa, Artificial Sequence
  AS66073 CDR3
GLSYCHSSTATATY

SEQ ID NO: 168 - protein, 8 aa, Artificial Sequence
  AS66439 CDR3
AEWGGMDY

SEQ ID NO: 169 - protein, 19 aa, Artificial Sequence
  AS65955 CDR3
PVDCSWSMFLQDPLALSPP

SEQ ID NO: 170 - protein, 16 aa, Artificial Sequence
  AS65233 CDR3
RTIFEGSWSSPSSFDF

SEQ ID NO: 171 - protein, 19 aa, Artificial Sequence
  AS65926 CDR3
VSIALTREFCAPIVSRYNY

SEQ ID NO: 172 - protein, 19 aa, Artificial Sequence
  AS66159 CDR3
ITVALTRAFCAPIPSRYTN

SEQ ID NO: 173 - protein, 19 aa, Artificial Sequence
  AS66416 CDR3
IPIALTRAFCAPIVSRYTY

SEQ ID NO: 174 - protein, 8 aa, Artificial Sequence
  AS65850 CDR3
GRCGGPNY

SEQ ID NO: 175 - protein, 23 aa, Artificial Sequence
  AS65183 CDR3
HLPSSWVTSTDYCDNLQAGFYNS

SEQ ID NO: 176 - protein, 8 aa, Artificial Sequence
  AS65062 CDR3
TSPMGDTY

SEQ ID NO: 177 - protein, 13 aa, Artificial Sequence
  AS65065 CDR3
DLVGCNVAGGSPY

SEQ ID NO: 178 - protein, 7 aa, Artificial Sequence
  AS65556 CDR3
ACPWRAY

SEQ ID NO: 179 - protein, 8 aa, Artificial Sequence
  AS65069 CDR3
TTRRGSEY

SEQ ID NO: 180 - protein, 8 aa, Artificial Sequence
  AS65691 CDR3
TGSGGVAY

SEQ ID NO: 181 - protein, 22 aa, Artificial Sequence
  AS65064 CDR3
VRVTVTWAEKLRRCTGFSGMDY

SEQ ID NO: 182 - protein, 20 aa, Artificial Sequence
  AS65081 CDR3
SHFLLCARKPRWDDLIKYEY

SEQ ID NO: 183 - protein, 13 aa, Artificial Sequence
  AS65115 CDR3
RTTGCNWDISGVY

SEQ ID NO: 184 - protein, 18 aa, Artificial Sequence
  AS65271 CDR3
GSAGRGPCDRFDQNQYTF

SEQ ID NO: 185 - protein, 17 aa, Artificial Sequence
  AS65166 CDR3
KYCAVVADFGNSRLVRY

SEQ ID NO: 186 - protein, 17 aa, Artificial Sequence
  AS65450 CDR3
KYCAVVAEFGGPRLVRY

SEQ ID NO: 187 - protein, 16 aa, Artificial Sequence
  AS65454 CDR3
YCAVVAEFRGPRLDRY

SEQ ID NO: 188 - protein, 17 aa, Artificial Sequence
  AS65131 CDR3
RQDRSGASMVNRDSYNY

SEQ ID NO: 189 - protein, 20 aa, Artificial Sequence
  AS65182 CDR3
NRLPNSDVDLVLPRFGRFGY

SEQ ID NO: 190 - protein, 19 aa, Artificial Sequence
  AS60685 CDR3
ISIALTREFCAPIVSRYNY

SEQ ID NO: 191 - protein, 19 aa, Artificial Sequence
  AS60702 CDR3
ITVALTRAFCAPIPSRYTN

SEQ ID NO: 192 - protein, 15 aa, Artificial Sequence
  AS60705 CDR3
DFTCRTWTLNKNYNH

SEQ ID NO: 193 - protein, 8 aa, Artificial Sequence
  AS60660 CDR3
TTRRGSEY

SEQ ID NO: 194 - protein, 13 aa, Artificial Sequence
  AS60662 CDR3
DLVGCNVAGGSPY

SEQ ID NO: 195 - protein, 18 aa, Artificial Sequence
  AS60664 CDR3
GSAGRGPCDRFDQNQYTF

SEQ ID NO: 196 - protein, 17 aa, Artificial Sequence
  AS60668 CDR3
KYCAVVAEFGGPRLVRY

SEQ ID NO: 197 - protein, 12 aa, Artificial Sequence
  AS60676 CDR3
YWGVYCLSPGRY

SEQ ID NO: 198 - protein, 15 aa, Artificial Sequence
  AS60678 CDR3
GYNGQWCEHASDVTA

SEQ ID NO: 199 - protein, 8 aa, Artificial Sequence
  AS60679 CDR3
NCASGLTA

SEQ ID NO: 200 - protein, 18 aa, Artificial Sequence
  AS81326 CDR3
GGLSRNTCGYLRGGYFAY

SEQ ID NO: 201 - protein, 18 aa, Artificial Sequence
  AS81187 CDR3
AVGVGDNWCASGAAYFGY

SEQ ID NO: 202 - protein, 16 aa, Artificial Sequence
  AS80533 CDR3
DRRPGTSMLAINGYNR

SEQ ID NO: 203 - protein, 16 aa, Artificial Sequence
  AS80444 CDR3
DRRPGTTMLAVNGYNH

SEQ ID NO: 204 - protein, 16 aa, Artificial Sequence
  AS81487 CDR3
TSIRSSCGLVRDEYAY

SEQ ID NO: 205 - protein, 245 aa, Artificial Sequence
  AD58126 scFv
QVQLKQSGAELAKPGASVEMSCKASGYTFTSYWMHWVKQRPGQGLEWIGYINPSTGHTDYNQKFKDKATLTADKSSSTAYMQLSSLTSEDSAVYYCARSNWAWFPYWGQGTLVTVSSGGGGSGGGGSGGGGSDIVMTQSPSSLTVTAGEKVTMSCKSSQSLLNSGNQKNYLTWYQQKPGKPPKLLIYWASTRESGVPDRFTGSGSGTDFTLTISSVQAEDLAVYYCQNDYSYPLTFGSGTRLEIK

SEQ ID NO: 206 - protein, 245 aa, Artificial Sequence
  AD58126VH3VL1 scFv
QVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIK

SEQ ID NO: 207 - protein, 240 aa, Artificial Sequence
  AD58116 scFv
QVQLKESGPELVKPGASVKISCKTSGYTFTEYTMNWVRQSHGKSLEWIGGIIPNNGDTSYNQKFKGKATLTVDKSSSTAYMELRSLTSEDSAVYYCAGRFAYWGQGTLVTVSSGGGGSGGGGSGGGGSDIVMTQAPLTLSVTIGQPASISCKSSQSLLDSDGKTYLNWFLQRPGQSPKRLIYLVSKLDSGVPDRFTGSGSGTDFTLKISRVEAEDLGVYYCWQGTHFPFTFGSGTKLEIK

SEQ ID NO: 208 - protein, 242 aa, Artificial Sequence
  AD58117 scFv
QVQLQQSGPELKKPGETVKISCKASFYTFTAYSMHWVKQAPGKGLKWMGWINTETGEPTYADDFKGRFAFSLETSATTAYLQINNLKNEDTATFFCARGLRRFAYWGQGTLVTVSSGGGGSGGGGSGGGGSDIVMTQSPTSLAVSLGQRATISCRASESVDSYGNSFMNWYQQKPGQPPKLLIYLASYLESGVPARFSGSGSRTDFTLTIDPVEADDAATYYCQQNNEDPYTFGGGTRLEIK

SEQ ID NO: 209 - protein, 244 aa, Artificial Sequence
  AD58127 scFv
QVQLQQSGAELVRPGASVTLSCKASGYTFTDYEIHWVKQTPVHGLEWIGGIDPETGGAAYTQKFKGKATLTADKSSSTAYMELRSLTSEDSAVYYCTTYGNYPLDSWGQGTTLTVSSGGGGSGGGGSGGGGSGIVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPLTFGAGTRLEIK

SEQ ID NO: 210 - protein, 244 aa, Artificial Sequence
  AD58143 scFv
QVQLKQSGAELVRPGASVTLSCKASGYTFTDYEMHWVKQTPVHGLEWIGGIDPETGGAAYTQKFKGKATPTADKSSSTAYMELRSLTSEDSAVYYCTTYGNYPLDSWGQGTTVTVSSGGGGSGGGGSGGGGSDIQMTQTPLSLPVSLGDQASISCRSSQSLVHSNGNTYLHWYLQKPGQSPKLLIYKVSNRFSGVPDRFSGSGSGTDFTLKISGVEAEDLGVYFCSQSTHVPLTFGAGTKLELK

SEQ ID NO: 211 - protein, 241 aa, Artificial Sequence
  AD58159 scFv
QVQLKQSGAELVRPGTSVKISCKASGYTITNYWLGWVKQRPGHGLEWIGDIYPGGGYTNYNEKFKGKATLTADTSSITAYMQLSSLTSEDSAVYFCARGGSSYWYFDVWGAGTSVTVSSGGGGSGGGGSGGGGSDIQMTQTTSSLSASLGDRVTISCSASQDISNYLNWYQQKPDGTVKLLIYYTSSLHSGVPSRFSGSGSGTDYSLTISNLEPEDIATYYCQQYSKVPYTFGGGTKLELK

SEQ ID NO: 212 - protein, 240 aa, Artificial Sequence
  AD58115 scFv
QVQLKQSGPELVKPGASVKISCKTSGYTFTEYTMNWVKQSHGKSLEWIGGIIPNNGDTSYKQEFKGKATLTVDKSSSTAYMELRSLTSDDSAVYYCAGRFAYWGQGTLVTVSSGGGGSGGGGSGGGGSDIVMTQTPLTLSVTIGQPASISCKSSQSLLDSDGKTYLNWFLQRPGQSPKRLIYLVSKLDSGVPDRFTGSGSGTDFTLKISRVEAEDLGVYYCWQGTHFPFTFGSGTKLEIK

SEQ ID NO: 213 - protein, 243 aa, Artificial Sequence
  AD58123 scFv
EVQLQQSGPGLVAPSQSLSITCTVSGFSLSRYSVHWVRQPPGKGLEWLGMIWGGGNTDYNSALKSRLSISKDNSKSQVFLKMNSLQTDDTAMYYCARSLGWYFDIWGAGTTVTVSSGGGGSGGGGSGGGGSDIVMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYLSSWTFGGGTKLEIK

SEQ ID NO: 214 - protein, 245 aa, Artificial Sequence
  AD58145 scFv
EVQLQQSGAELAKPGASVKMSCKASGYTFTSYWMHWVKQRPGQGLEWIGYINPSTGYTDYNQKFKDKATLTADKSSSTAYMQLSSLTSEDSAVYYCARSNWAWFPYWGQGTLVTVSSGGGGSGGGGSGGGGSDIQMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 215 - protein, 241 aa, Artificial Sequence
  AS51489 scFv
EVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIK

SEQ ID NO: 216 - protein, 237 aa, Artificial Sequence
  AS51491 scFv
EVQLVESGGGLVQPGGSLRLSCAASGFNLYSYSMHWVRQAPGKGLEWVAYIYPYSGSTYYADSVKGRFTISADTSKNTAYLQMNSLRAEDTAVYYCARGYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQSYYWLFTFGQGTKVEIK

SEQ ID NO: 217 - protein, 240 aa, Artificial Sequence
  AS92110 scFv
EVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIK

SEQ ID NO: 218 - protein, 238 aa, Artificial Sequence
  AS91156 scFv
EVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIK

SEQ ID NO: 219 - protein, 238 aa, Artificial Sequence
  AS91189 scFv
EVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIK

SEQ ID NO: 220 - protein, 241 aa, Artificial Sequence
  AS51674 scFv
EVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIK

SEQ ID NO: 221 - protein, 121 aa, Artificial Sequence
  AS66073 sdAb
QVQLVESGGDSVQAGGSLTLACTGRKYSSLYCMAWFRQAPGKAREGVAVISSGGFTNYADSVKGRFTISRDNSKNTLYLAMNGLKPEDTAMYYCAAGLSYCHSSTATATYRGQGTQVTVSS

SEQ ID NO: 222 - protein, 119 aa, Artificial Sequence
  AS66439 sdAb
QMQLVESGGGSVQAGGSLRLSCTAPGFTSSDCDMDWYRQAAGNQREWVSSLLSTDGSTSYADSVRGRFTISKDPAKDTVYLQMNSLKPEDTAMYFCRCVVAEWGGMDYWGKGTLVTVSS

SEQ ID NO: 223 - protein, 127 aa, Artificial Sequence
  AS65955 sdAb
QVHLVESGGGSVQAGGSLRLSCAASGDRVSTGCMGWFRQGPGEEREGLAQIHNYNIAKYADSVKGRFTISKDNAKNILYLQMNSLKPEDTGLYICTAPVDCSWSMFLQDPLALSPPRGQGTQVTVSS

SEQ ID NO: 224 - protein, 122 aa, Artificial Sequence
  AS65233 sdAb
QVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSS

SEQ ID NO: 225 - protein, 131 aa, Artificial Sequence
  AS65926 sdAb
QVQLVESGGGSVQAGGSLRLSCAASGNLYNNMCMGWFRQAPGKEREGVASIYIGGGYTNYADSVKGRFTISPISRDNAKSTLYLQMNSLKPEDTAMYYCAAVSIALTREFCAPIVSRYNYWGQGTQVTVSS

SEQ ID NO: 226 - protein, 128 aa, Artificial Sequence
  AS66159 sdAb
QVRLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSS

SEQ ID NO: 227 - protein, 128 aa, Artificial Sequence
  AS66416 sdAb
QVQLAESGGGSVQAGGSLRLSCAASGNLYNNMCMGWFRQAPGKEREGVGSIYIGGGYTNYSESVRGRFTISLDNAKKTLNLQMNSLKPEDTAMYYCAAIPIALTRAFCAPIVSRYTYWGQGTQVTVSS

SEQ ID NO: 228 - protein, 116 aa, Artificial Sequence
  AS65850 sdAb
EVQLMESGGGSVQAGGSLRLSCAASGFSYSNICMGWFRQAPGKEREGVAAIYSNGSTIYADSVKGRFTVSKEFAKNTQYLQMNSLKPEDTAMYYCAAGRCGGPNYWGQGTQVTVSS

SEQ ID NO: 229 - protein, 132 aa, Artificial Sequence
  AS65183 sdAb
EVQLAESGGGSAQAGGSLRLSCASNGYYNRRYCMAWFRQAPGKEREGVATMTTTSGRTYYADAVKGRFTVSQDNAKSTLYLQMSSLKPEDTAMYYCAAHLPSSWVTSTDYCDNLQAGFYNSWGQGTQVTVSS

SEQ ID NO: 230 - protein, 116 aa, Artificial Sequence
  AS65062 sdAb
QVHLVESGGGSVQAGGSLRLSCAASGVSVVNFAMRWYRQAPGNEREFVSAMYRSGSTSYADSVRGRFTISRDSALNTVFLQMSGLKPEDTATYYCQATSPMGDTYWGQGTQVTVSS

SEQ ID NO: 231 - protein, 121 aa, Artificial Sequence
  AS65065 sdAb
EVQLAESGGGSVQAGGSLRLSCAASGYSYCRSTMRWYRQAPGNVREFVSAIYSDGTTSYTDSVKGRFTISQDNAKNTVYLQMNSLQPEDTAMYYCRIDLVGCNVAGGSPYWGQGTQVTVSS

SEQ ID NO: 232 - protein, 115 aa, Artificial Sequence
  AS65556 sdAb
QVHLVESGGGSVQVGGSLRLSCAASGYNASICRMSWYRQAPGTEREFVSSSYRDGSQSYADSVKGRFTTSRDSAKNTVFLQMNSLKPSDTAMYYCNAACPWRAYWGQGTQVTVSS

SEQ ID NO: 233 - protein, 116 aa, Artificial Sequence
  AS65069 sdAb
QVHLVESGGGSVQAGGSLRLSCVASGDTGYQPTMRWYRQAPGKEREFVSAIYSDQTTSYADSVKGRFTISQDNARKTVYLQMASLKPEDTAMYYCKLTTRRGSEYWGQGTQVTVSS

SEQ ID NO: 234 - protein, 116 aa, Artificial Sequence
  AS65691 sdAb
QMQLVESGGGSVQAGGSLRLSCTVSGYTDYRLVLRWYRQALGKEREFISAIYSDGVTSYSDSVKGRFTISRDNAKNTAYLQMNSLKSEDTAMYYCKATGSGGVAYWGQGTQVTVSS

SEQ ID NO: 235 - protein, 134 aa, Artificial Sequence
  AS65064 sdAb
QVQLVESGGGSVQAGGSLKLSCAVSGDTVQTNCMAWFRQAPGKEREAVASILSLYSSGGKTVYADSVKGRFTISPDNAQNTVSLQMNNLKPEDTAMYYCATVRVTVTWAEKLRRCTGFSGMDYWGKGTLVTVSS

SEQ ID NO: 236 - protein, 128 aa, Artificial Sequence
  AS65081 sdAb
QVHLMESGGGSVQAGGSLRLSCAASGVPASSYCMGWFRQAPGKEREGVAGIVSDTTTTYADSVKGRFTISKDNAKNTLYLQMNSLKPEDTATYYCAASHFLLCARKPRWDDLIKYEYWGQGTQVTVSS

SEQ ID NO: 237 - protein, 119 aa, Artificial Sequence
  AS65115 sdAb
QVQLVESGGGSVQAGGSLRLSCAASGYIYGCMGWFRRAPGKAREEVATIYRDGTAYYANSVEGRFTASRNNAENTLSLEMNSLNAEDTAMYYCAARTTGCNWDISGVYWGQGTQVTVSS

SEQ ID NO: 238 - protein, 126 aa, Artificial Sequence
  AS65271 sdAb
QMQLVESGGGSVQAGGSLTLSCAASGKTYGRCMAWFRQAPGKERELVAATYISGGRPYVADSVKGRFTISRDNAKSTMSLQMNSLRPDDSAMYYCAAGSAGRGPCDRFDQNQYTFWGQGTQVTVSS

SEQ ID NO: 239 - protein, 128 aa, Artificial Sequence
  AS65166 sdAb
QVQLVESGGGSVQAGGSLRLSCTASEDLSIYGYNCMGWFRQAPGKEREAVAAIYTGRGTTYYADSVKGRFTISQDNAKNTVYLQMNSLKPEDTAMYYCASKYCAVVADFGNSRLVRYWGQGTQVTVSS

SEQ ID NO: 240 - protein, 126 aa, Artificial Sequence
  AS65450 sdAb
QVRLVESGGGSVQAGGSLRLSCAASGDMNGYKCMGWFRQAPGKEREAVAGIYTGRGTTYYADSVKDRFTISQDNAKNTVYLQMNSLKPEDTAMYYCAAKYCAVVAEFGGPRLVRYWGQGTQVTVSS

SEQ ID NO: 241 - protein, 125 aa, Artificial Sequence
  AS65454 sdAb
QVRLVESGGGSVQAGGSLRLSCAASGDMNGYKCMGWFRQAPGKEREAVAGIYTGRNTTYYADSVKDLFTISQDNAQNTVFLQMNSLKPEDTAMYYCASYCAVVAEFRGPRLDRYWGYGTQVTVTS

SEQ ID NO: 242 - protein, 123 aa, Artificial Sequence
  AS65131 sdAb
EVQLAESGGGSVQAGGSLTLSCTASEYVTHLGWFRQAPGKEREGVAIESFRIGYTYYADSVKGRFTISHDNAKNTLYLQMNSLKPEDTAIYYCAARQDRSGASMVNRDSYNYWGKGTQVTVSS

SEQ ID NO: 243 - protein, 129 aa, Artificial Sequence
  AS65182 sdAb
QVKLVESGGGSVQAGGSLRLSCAASGYTYSYGYMGWFRQAPGKEREGVAKIYNGDGSTYYADSVKGRFTISQDRRNNTLYLQMNSLAPEDTGMYYCATNRLPNSDVDLVLPRFGRFGYWGQGTQVTVSS

SEQ ID NO: 244 - protein, 128 aa, Artificial Sequence
  AS60685 sdAb
QVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSS

SEQ ID NO: 245 - protein, 128 aa, Artificial Sequence
  AS60702 sdAb
QVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSS

SEQ ID NO: 246 - protein, 125 aa, Artificial Sequence
  AS60705 sdAb
QVQLVESGGGSVQSGGSLRLSCAASGYAYSGSCMMAWFRQAPGKEREGVAVSVRRTGSAFYADSVKARFTISRDNAKNTLYLQMNNLKVEDTAMYYCAADFTCRTWTLNKNYNHWGQGTQVTVSS

SEQ ID NO: 247 - protein, 116 aa, Artificial Sequence
  AS60660 sdAb
QVHLMESGGGSVQAGGSLRLSCVASGDTGYQPTMRWYRQAPGKEREFVSAIYSDQTTSYADSVKGRFTISQDNARKTVYLQMASLKPEDTAMYYCKLTTRRGSEYWGQGTQVTVSS

SEQ ID NO: 248 - protein, 121 aa, Artificial Sequence
  AS60662 sdAb
QVHLVESGGGSVQAGGSLRLSCVASGYRNCRSTMRWYRQGPGQVRDWVSSIYTDGTTSYTDSVKGRFTIAQDKGKNTVYLQMNSLQPEDTAMYYCRIDLVGCNVAGGSPYWGHGTQVTVSS

SEQ ID NO: 249 - protein, 126 aa, Artificial Sequence
  AS60664 sdAb
QVHLVESGGGSVQAGGSLTLSCAASGKTYGRCMAWFRQAPGKERELVAATYISGGRPYVADSVKGRFTISRDNAKSTMSLQMNSLRPDDSAMYYCAAGSAGRGPCDRFDQNQYTFWGQGTQVTVSS

SEQ ID NO: 250 - protein, 126 aa, Artificial Sequence
  AS60668 sdAb
QVHLVESGGGSVQAGGSLRLSCAASGDMNGYKCMGWFRQAPGKEREAVAGIYTGRNTTYYADSVKDRFTISQDNAKNTVFLQMNSLKPEDTAMYYCASKYCAVVAEFGGPRLVRYWGQGTQVTVSS

SEQ ID NO: 251 - protein, 120 aa, Artificial Sequence
  AS60676 sdAb
QVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSS

SEQ ID NO: 252 - protein, 124 aa, Artificial Sequence
  AS60678 sdAb
QVHLVESGGGSVQAGGSLRLSCAVSGYTSSRGCMSWFRQAPGKERERVAYINMRVLTTIYAASVKDRFAISRDNAKNTVDLQMNNLKPEDTAMYYCAAGYNGQWCEHASDVTAWGQGTQVTVSS

SEQ ID NO: 253 - protein, 116 aa, Artificial Sequence
  AS60679 sdAb
QVHLMESGGGSVQAGGSLRLSCARSGVTYCRLTMRWYRQAPGSEREFVSAIYSDGSTAYADSVKGRFTMSQDDAKNTVYLQMNSVKPEDTAMYYCKLNCASGLTAWGQGTQVTVSS

SEQ ID NO: 254 - protein, 124 aa, Artificial Sequence
  AS81326 sdAb
EVQLVESGGGSVQAGGSLTLSCAASESRDCMAWFRQAPGKAREGVASIYAPDGSTTYADTVKGRFTISQDNAKNTLYLQMNSLQPEDAAMYHCAIGGLSRNTCGYLRGGYFAYFGRGTQVTVSS

SEQ ID NO: 255 - protein, 130 aa, Artificial Sequence
  AS81187 sdAb
QVRLVESGGGSVQAGGSLRLSCAASGYTYSSYSSNCLGWFRQAPGKEREAVARIYPNSGSTYYADSVKGRFTISQDNAKNTVYLQMNSLKPEDTAMYYCAVAVGVGDNWCASGAAYFGYWGQGTQVTVSS

SEQ ID NO: 256 - protein, 125 aa, Artificial Sequence
  AS80533 sdAb
QVHLVESGGGSVQTGGSLRLSCTASGLSFSTYTVAWFRQAPGKEREGVAAIPYTSQHMVYTDSVKGRFTISRDNTKNMVYLQMNSLKPEDTAMYYCATDRRPGTSMLAINGYNRWGQGTQVTVSS

SEQ ID NO: 257 - protein, 125 aa, Artificial Sequence
  AS80444 sdAb
EVQLAESGGGSVQAGGSLRLSCAASGFTFSRNTMGWFRQAPGKEREGVAAIPYTSTGIVYSDSVGGRFTISRDNTKNMVYLQMNNLEPEDTAMYYCATDRRPGTTMLAVNGYNHWGQGTQVTVSS

SEQ ID NO: 258 - protein, 125 aa, Artificial Sequence
  AS81487 sdAb
QVRLVESGGGSVQAGGSLRVSCLVSKLTAWRSCVGWFRQAPGKEREGVAAIYSGTGSTYYADSVKGRFTIAQDYAKNMVYLQMNSLKPEDTAMYYCAGTSIRSSCGLVRDEYAYWGQGTQVTVSS

SEQ ID NO: 259 - DNA, 735 bp, Artificial Sequence
  AD58126 scFV
caggtgcagctgaagcagtctggggctgaactggcaaaacctggggcctcagtggagatgtcctgcaaggcttctggctacacctttactagctactggatgcactgggtaaaacagaggcctggacagggtctggaatggattggatacattaatcctagtactggtcatactgactacaatcagaagttcaaggacaaggccacattgactgcagacaaatcctccagcacagcctacatgcaactgagcagcctgacatctgaggactctgcagtctattactgtgcaagatccaactgggcctggtttccttactggggccaagggactctggtcactgtctcgagcggtggaggcggttcaggcggaggtggctctggcggtggcgggtcggacattgtgatgactcagtctccatcctccctgactgtgacagcaggagagaaggtcactatgagctgcaagtccagtcagagtctgttaaacagtggaaatcaaaagaactacttgacctggtaccagcagaaaccagggaagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggttctgggaccagactggaaataaaa

SEQ ID NO: 260 - DNA, 735 bp, Artificial Sequence
  AD58126VH3VL1 scFV
caggtgcagctggtgcagtccggagcagaggtgaagaagccaggagccagcgtgaaggtgtcctgcaaggcctctggctacaccttcacaagctattggatgcactgggtgaagcaggcaccaggacagggactggagtggatcggctacatcaatccctccacaggccacaccgactataaccagaagtttaaggatcgggccaccctgacagccgacacctctacaagcaccgtgtacatggagctgagctccctgaggtccgaggatacagccgtgtactattgcgcccgctctaattgggcctggttcccctattggggccagggcacactggtgaccgtgtctagcggaggaggaggatccggaggaggaggatctggcggcggcggcagcgatatcgtgatgacacagtcccctgactctctggccgtgtctctgggagagagggcaaccatcaactgtaagtcctctcagagcctgctgaactccggcaatcagaagaactacctgacctggtatcagcagaagcctggccagccccctaagctgctgatctactgggcatctacaagggagagcggagtgccagatagattctccggctctggcagcggcaccgactttacactgaccatcagctccctgcaggccgaggatgtggccgtgtactattgtcagaatgactacagctatcccctgacatttggcggcggcaccaagctggagatcaag

SEQ ID NO: 261 - DNA, 720 bp, Artificial Sequence
  AD58116 scFV
caggtgcagctgaaggagtctggacctgagctggtgaagcctggggcttcagtgaagatatcctgcaagacttctggatacacattcactgaatacaccatgaactgggtgaggcagagccatggaaagagccttgagtggattggaggtattattcctaacaatggtgatactagctacaaccagaagttcaagggcaaggccacattgactgtagacaagtcctccagcacagcctacatggaactccgcagcctgacatctgaggattctgcagtctattactgtgcagggcggtttgcttactggggccaagggactctggtcactgtctcgagcggtggaggcggttcaggcggaggtggctctggcggtggcgggtcggatattgtgatgacccaggctccactcactttgtcggttaccattggacaaccagcctccatctcttgcaagtcaagtcagagcctcttagatagtgatggaaagacatatttgaattggttcttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttccattcacgttcggctcgggcacaaagttggaaataaaa

SEQ ID NO: 262 - DNA, 726 bp, Artificial Sequence
  AD58117 scFV
caggtccagctgcagcagtctggacctgagctgaagaagcctggagagaccgtcaagatctcctgcaaggcttctttttataccttcacagcctattcaatgcactgggtgaagcaggctccaggaaagggtttaaagtggatgggctggataaacactgagactggtgagccaacatatgcagatgacttcaagggacggtttgccttctctttggaaacctctgccaccactgcctatttgcagatcaacaacctcaaaaatgaggacacggctacatttttctgtgctaggggactacggcggtttgcttactggggccaggggactctggtcactgtctcgagcggtggaggcggttcaggcggaggtggctctggcggtggcgggtcggacattgtgatgacacagtctccaacttctttggctgtgtctctagggcagagggccaccatatcctgcagagccagtgaaagtgttgatagttatggcaatagttttatgaattggtaccagcagaaaccaggacagccacccaaactcctcatctatcttgcatcctacctagaatctggggtccctgccaggttcagtggcagtgggtctaggacagacttcaccctcaccattgatcctgtggaggctgatgatgctgcaacctattactgtcagcaaaataatgaggatccgtacacgttcggaggggggaccagactggaaataaaa

SEQ ID NO: 263 - DNA, 732 bp, Artificial Sequence
  AD58127 scFV
caggttcagctgcagcagtctggggctgaactggtgaggcctggggcttcagtgacgctgtcctgcaaggcttcgggctacacatttactgactatgaaattcactgggtgaagcagacacctgtgcatggcctggaatggattggaggtattgatcctgaaactggtggtgctgcctacactcagaagttcaagggcaaggccacactgactgcagacaaatcctccagcacagcctacatggagctccgcagcctgacatctgaggactctgccgtctattactgtacaacttatggtaactacccccttgactcctggggccaaggcaccactctcacagtctcgagcggtggaggcggttcaggcggaggtggctctggcggtggcgggtcgggtattgtgatgacccagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgttccgctcacgttcggtgctgggaccagactggaaataaaa

SEQ ID NO: 264 - DNA, 732 bp, Artificial Sequence
  AD58143 scFV
caggtgcaactgaagcagtctggggctgaactggtgaggcctggggcttcagtgacgctgtcctgcaaggcttcgggctacacatttactgactatgaaatgcactgggtgaagcagacacctgtgcatggcctggaatggatcggaggtattgatcctgaaactggtggtgctgcctacactcagaagttcaagggcaaggccacaccgactgcagacaaatcctccagcacagcctacatggagctccgcagcctgacatctgaggactctgccgtctattactgtacaacttatggtaactacccccttgactcctggggccaaggcaccacggtcaccgtctcgagcggtggaggcggttcaggcggaggtggctctggcggtggcgggtcggatatccagatgacacagactccactctccctgcctgtcagtcttggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcggagtggaggctgaggatctgggagtttatttctgctctcaaagtacacatgttccgctcacgttcggtgctgggaccaagctggagctgaaa

SEQ ID NO: 265 - DNA, 723 bp, Artificial Sequence
  AD58159 scFV
caggtgcaactgaagcagtctggagctgagctggtaaggcctgggacttcagtgaagatatcctgcaaggcttctggctacaccatcactaactactggctaggttgggtaaagcagaggccaggacatggacttgagtggattggagatatttaccctggaggtggttatactaactacaatgagaagttcaagggcaaggccacactgactgcagacacatcctccatcactgcctacatgcagctcagtagcctgacatctgaggactctgctgtctatttctgtgcaagaggcggtagtagctactggtacttcgatgtctggggcgcagggacctcagtcaccgtctcgagcggtggaggcggttcaggcggaggtggctctggcggtggcgggtcggatatccagatgacacagactacatcctccctgtctgcctctctgggagacagagtcaccatcagttgcagtgcaagtcaggacattagcaattatttaaactggtatcagcagaaaccagatggaactgttaaactcctgatctattacacatcaagtttacactcaggagtcccatcaaggttcagtggcagtgggtctgggacagattattctctcaccatcagcaacctggaacctgaagatattgccacttactattgtcagcagtatagtaaggttccgtacacgttcggaggggggaccaagctggagctgaaa

SEQ ID NO: 266 - DNA, 720 bp, Artificial Sequence
  AD58115 scFV
caggtgcagctgaagcagtctggacctgagctggtgaagcctggggcttcagtgaagatatcctgcaagacttctggatacacattcactgaatacaccatgaactgggtgaagcagagccatggaaagagccttgagtggattggaggaattattcctaacaatggtgatactagctacaaacaggagttcaagggcaaggccacattgactgtagacaagtcctccagcacagcctacatggagctccgcagcctgacatctgacgattctgcagtctattactgtgcagggcggtttgcttactggggccaagggactctggtcactgtctcgagcggtggaggcggttcaggcggaggtggctctggcggtggcgggtcggatattgtgatgacccagactccactcactttgtcggttaccattggacaaccagcctccatctcttgcaagtcaagtcagagcctcttagatagtgatggaaagacatatttgaattggttcttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttccattcacgttcggctcgggcacaaagttggaaataaaa

SEQ ID NO: 267 - DNA, 729 bp, Artificial Sequence
  AD58123 scFV
gaggtccagctgcagcagtcaggacctggcctggtggcaccctcacagagcctgtccatcacatgcactgtctctgggttctcattatccagatatagtgtacactgggttcgccagcctccaggaaagggtctggagtggctgggaatgatatggggtggtggaaacacagactataattcagctctcaaatccagactgagcatcagcaaggacaactccaagagccaagttttcttaaaaatgaacagtctgcaaactgatgacacagccatgtactactgtgccagaagcctgggctggtacttcgatatctggggcgcagggaccacggtcaccgtctcgagcggtggaggcggttcaggcggaggtggctctggcggtggcgggtcggacattgtgatgacacagtcgccatcatctctggctgtgtctgcaggagaaaaggtcactatgagctgtaagtccagtcaaagtgttttatacagttcaaatcagaagaactacttggcctggtaccagcagaaaccagggcagtctcctaaactgctgatctactgggcatccactagggaatctggtgtccctgatcgcttcacaggcagtggatctgggacagattttactcttaccatcagcagtgtacaagctgaagacctggcagtttattactgtcatcaatacctctcctcgtggacgttcggtggaggcacaaagctggaaatcaaa

SEQ ID NO: 268 - DNA, 735 bp, Artificial Sequence
  AD58145 scFV
gaggttcagctgcaacagtctggggctgaactggcaaaacctggggcctcagtgaagatgtcctgcaaggcttctggctacacctttactagctactggatgcactgggtaaaacagaggcctggacagggtctggaatggattggatacattaatcctagcactggttatactgactacaatcagaagttcaaggacaaggccacattgactgcagacaaatcctccagcacagcctacatgcaactgagcagcctgacatctgaggactctgcagtctattactgtgcaagatccaactgggcctggtttccttactggggccaagggactctggtcactgtctcgagcggtggaggcggttcaggcggaggtggctctggcggtggcgggtcggacatccagatgacacagtctccatcctccctgactgtgacagcaggagagaaggtcactatgagctgcaagtccagtcagagtctgttaaacagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtgtgcaggctgaagacctggcagtttattactgtcagaatgattatagttatccgctcacgttcggtgctgggaccaagctggagctgaaa

SEQ ID NO: 269 - DNA, 723 bp, Artificial Sequence
  AS51489 scFV
gaggttcaactggtggagagcggtggtggtctggttcagccgggtggtagcctgcgtctgagctgcgcagcttctggcttcaacctctattattattctatccactgggtgcgtcaggcgccgggtaaaggcctggaatgggttgcatatatttcttcttcttctagctatacttattatgccgatagcgtcaagggccgtttcaccatcagcgcggataccagcaaaaacaccgcatacctgcaaatgaacagcctgcgtgcggaagataccgccgtctattattgtgctcgctactacccgtactacggtatggactactggggtcaaggcaccctggttaccgtgagcagcggtggaggcggttcaggcggaggtggctctggcggtggcgggtcggacatccagatgacccagagcccgagcagcctgagcgcgagcgttggtgaccgtgttaccattacctgccgtgcgagccagagcgttagcagcgcggtggcgtggtaccagcaaaagccgggtaaagcgccgaagctgctgatctatagcgcgagcagcctgtatagcggcgttccgagccgtttcagcggtagccgtagcggcaccgactttaccctgaccattagcagcctgcagccggaagatttcgcaacttattactgtcagcaaggtttctcttactacccgatcacgttcggacagggcaccaaagttgagattaaa

SEQ ID NO: 270 - DNA, 711 bp, Artificial Sequence
  AS51491 scFV
gaggttcaactggtggagagcggtggtggtctggttcagccgggtggtagcctgcgtctgagctgcgcagcttctggcttcaacctctattcttattctatgcactgggtgcgtcaggcgccgggtaaaggcctggaatgggttgcatatatttatccttattctggctctacttattatgccgatagcgtcaagggccgtttcaccatcagcgcggataccagcaaaaacaccgcatacctgcaaatgaacagcctgcgtgcggaagataccgccgtctattattgtgctcgcggttacggtatggactactggggtcaaggcaccctggttaccgtgagcagcggtggaggcggttcaggcggaggtggctctggcggtggcgggtcggacatccagatgacccagagcccgagcagcctgagcgcgagcgttggtgaccgtgttaccattacctgccgtgcgagccagagcgttagcagcgcggtggcgtggtaccagcaaaagccgggtaaagcgccgaagctgctgatctatagcgcgagcagcctgtatagcggcgttccgagccgtttcagcggtagccgtagcggcaccgactttaccctgaccattagcagcctgcagccggaagatttcgcaacttattactgtcagcaatcttactactggctgttcacgttcggacagggcaccaaagttgagattaaa

SEQ ID NO: 271 - DNA, 720 bp, Artificial Sequence
  AS92110 scFV
gaggttcaactggtggagagcggtggtggtctggttcagccgggtggtagcctgcgtctgagctgcgcagcttctggcttcaacatctattattcttctatgcactgggtgcgtcaggcgccgggtaaaggcctggaatgggttgcatatatttatccttattatagctatacttattatgccgatagcgtcaagggccgtttcaccatcagcgcggataccagcaaaaacaccgcatacctgcaaatgaacagcctgcgtgcggaagataccgccgtctattattgtgctcgcggttacgctttggactactggggtcaaggcaccctggttaccgtgagcagcggtggaggcggttcaggcggaggtggctctggcggtggcgggtcggacatccagatgacccagagcccgagcagcctgagcgcgagcgttggtgaccgtgttaccattacctgccgtgcgagccagagcgttagcagcgcggtggcgtggtaccagcaaaagccgggtaaagcgccgaagctgctgatctatagcgcgagcagcctgtatagcggcgttccgagccgtttcagcggtagccgtagcggcaccgactttaccctgaccattagcagcctgcagccggaagatttcgcaacttattactgtcagcaagcttcttctggttaccattacctgatcacgttcggacagggcaccaaagttgagattaaa

SEQ ID NO: 272 - DNA, 714 bp, Artificial Sequence
  AS91156 scFV
gaggttcaactggtggagagcggtggtggtctggttcagccgggtggtagcctgcgtctgagctgcgcagcttctggcttcaacatctattcttcttctatccactgggtgcgtcaggcgccgggtaaaggcctggaatgggttgcatctatttcttcttattctagctatacttcttatgccgatagcgtcaagggccgtttcaccatcagcgcggataccagcaaaaacaccgcatacctgcaaatgaacagcctgcgtgcggaagataccgccgtctattattgtgctcgctactacgctatggactactggggtcaaggcaccctggttaccgtgagcagcggtggaggcggttcaggcggaggtggctctggcggtggcgggtcggacatccagatgacccagagcccgagcagcctgagcgcgagcgttggtgaccgtgttaccattacctgccgtgcgagccagagcgttagcagcgcggtggcgtggtaccagcaaaagccgggtaaagcgccgaagctgctgatctatagcgcgagcagcctgtatagcggcgttccgagccgtttcagcggtagccgtagcggcaccgactttaccctgaccattagcagcctgcagccggaagatttcgcaacttattactgtcagcaaggtccgtactaccatccgatcacgttcggacagggcaccaaagttgagattaaa

SEQ ID NO: 273 - DNA, 714 bp, Artificial Sequence
  AS91189 scFV
gaggttcaactggtggagagcggtggtggtctggttcagccgggtggtagcctgcgtctgagctgcgcagcttctggcttcaacctctcttattcttctatccactgggtgcgtcaggcgccgggtaaaggcctggaatgggttgcatctatttattcttattctggctctacttattatgccgatagcgtcaagggccgtttcaccatcagcgcggataccagcaaaaacaccgcatacctgcaaatgaacagcctgcgtgcggaagataccgccgtctattattgtgctcgctactggggtatggactactggggtcaaggcaccctggttaccgtgagcagcggtggaggcggttcaggcggaggtggctctggcggtggcgggtcggacatccagatgacccagagcccgagcagcctgagcgcgagcgttggtgaccgtgttaccattacctgccgtgcgagccagagcgttagcagcgcggtggcgtggtaccagcaaaagccgggtaaagcgccgaagctgctgatctatagcgcgagcagcctgtatagcggcgttccgagccgtttcagcggtagccgtagcggcaccgactttaccctgaccattagcagcctgcagccggaagatttcgcaacttattactgtcagcaatactactggtactacccgatcacgttcggacagggcaccaaagttgagattaaa

SEQ ID NO: 274 - DNA, 723 bp, Artificial Sequence
  AS51674 scFV
gaggttcaactggtggagagcggtggtggtctggttcagccgggtggtagcctgcgtctgagctgcgcagcttctggcttcaacctctattcttattatatgcactgggtgcgtcaggcgccgggtaaaggcctggaatgggttgcatctatttattcttattctagctatacttcttatgccgatagcgtcaagggccgtttcaccatcagcgcggataccagcaaaaacaccgcatacctgcaaatgaacagcctgcgtgcggaagataccgccgtctattattgtgctcgcccgttcggttggggttacgctggtatggactactggggtcaaggcaccctggttactgtgagcagcggtggaggcggttcaggcggaggtggctctggcggtggcgggtcggacatccagatgacccagagcccgagcagcctgagcgcgagcgttggtgaccgtgttaccattacctgccgtgcgagccagagcgttagcagcgcggtggcgtggtaccagcaaaagccgggtaaagcgccgaagctgctgatctatagcgcgagcagcctgtatagcggcgttccgagccgtttcagcggtagccgtagcggcaccgactttaccctgaccattagcagcctgcagccggaagatttcgcaacttattactgtcagcaaggttacgctccgatcacgttcggacagggcaccaaagttgagattaaa

SEQ ID NO: 275 - DNA, 363 bp, Artificial Sequence
  AS66073 sdAb
caggttcagctggtggagtctgggggagactcggtgcaggctggggggtctctgacactcgcctgtacagggcgtaaatacagcagtctatactgcatggcctggttccgccaggctccagggaaggcgcgcgagggggtcgcagttattagcagtggcggcttcacaaattacgctgactccgtaaagggccgattcaccatctccagagacaactccaagaacacgctgtatctggcaatgaacggcctgaaacctgaggacactgccatgtactactgtgcggcaggcctatcctattgccattcaagcacagcaaccgccacgtaccggggccaggggacccaggtcaccgtctcctca

SEQ ID NO: 276 - DNA, 357 bp, Artificial Sequence
  AS66439 sdAb
cagatgcagctggtggagtctgggggaggctcggtgcaggctggggggtctctgagactctcctgcacagcccctggattcacctccagtgactgcgacatggactggtaccgccaggctgcagggaatcagcgcgaatgggtctcatctcttcttagtactgacggtagcacaagctatgcggactccgtgaggggccgattcaccatctccaaagacccagccaaggacacggtgtatctgcaaatgaacagcctgaaacctgaggacacggccatgtatttctgtaggtgtgtcgtggctgagtggggcggcatggactactggggcaaaggaaccctggtcaccgtctcctca

SEQ ID NO: 277 - DNA, 381 bp, Artificial Sequence
  AS65955 sdAb
caggtgcacctggtggagtctgggggaggctcggtgcaggctggagggtctctgagactctcctgtgcagcctctggcgaccgcgtcagtactggctgtatgggctggttccgccagggtccaggcgaggagcgcgaggggctcgcacaaattcacaattataatatcgcaaagtacgcagactccgtgaagggccgattcaccatctccaaagacaacgccaagaacattctgtatctgcaaatgaacagcctgaaacctgaggacactggcttgtacatctgtacggctcctgtagattgtagctggagcatgtttctgcaagacccacttgcgttgtctccacctaggggccaggggacccaggtcaccgtctcctca

SEQ ID NO: 278 - DNA, 366 bp, Artificial Sequence
  AS65233 sdAb
caggtgcacctggtggagtctgggggaggctcggtgcaggctggagggtctctgagactctcctgtgcagcctctgaattcacgtacagtatgggctggttccgccaggctccagggaaggagcgcgagggcgtcgcacatatttacactcgtggtggtaccacggtctatgccgactccgtgaagggccgattcgtcctctcccgatacaacgccaagagcataatgtatctacaaatgaacagcgtgaaacttgaggacactgccatgtattactgtgcggcccggaccatattcgaaggtagctggtcgtccccatcctcgtttgacttctggggccaggggacccaggtcaccgtctcctca

SEQ ID NO: 279 - DNA, 393 bp, Artificial Sequence
  AS65926 sdAb
caggtgcagctggtggagtctgggggaggctcggtgcaggctggagggtctctgagactctcctgtgcagcctctggaaacctctacaataacatgtgcatgggctggttccggcaggctccagggaaggagcgcgagggggtcgcaagtatttatattggtggtggttacaccaactatgccgactccgtgaagggccgattcaccatctcccccatctcccgagacaacgccaagagcacgctgtatctgcaaatgaacagcctgaaacctgaggacactgccatgtactactgtgcggcagtctccatcgcgcttacgagggaattctgcgccccgatcgtttctcggtataattactggggccaggggacccaggtcaccgtctcctca

SEQ ID NO: 280 - DNA, 384 bp, Artificial Sequence
  AS66159 sdAb
caggtgaggttggtggagtctgggggaggctcggtgcaggctggagggtctctgagactctcatgtgcagcctctggaaacgtctacaataacatgtgcatgggctggttccgccaggctccagggaaggagcgcgagggggtcgcaagtatctatgttggtggtggttacaccaactatgccgactccgtgaggggccgattcaccatctcccaagacaacgccaagaacacgctgtatctgcaaatgaacagcctgaaacctgaggacactgccatgtactactgtgcggcaattaccgtcgcgcttacgagggctttctgcgccccgatcccttctcggtataccaactggggccaggggacccaggtcaccgtctcctca

SEQ ID NO: 281 - DNA, 384 bp, Artificial Sequence
  AS66416 sdAb
caggtgcagctggcggagtctgggggaggttcggtgcaggctggagggtctctgagactctcctgtgcagcctctggaaacctctacaataacatgtgcatgggctggttccgccaggctccagggaaggagcgcgagggggtcggaagtatttatattggtggtggttacaccaactattccgaatccgtgaggggccgattcaccatctccctagacaacgccaagaagacgctgaatctgcaaatgaacagcctgaaacctgaggacactgccatgtactactgtgcggcaatccccatcgcgcttacgagggctttctgcgccccgatcgtttctcggtatacgtactggggccaggggacccaggtcaccgtctcctca

SEQ ID NO: 282 - DNA, 348 bp, Artificial Sequence
  AS65850 sdAb
gaggtgcagctgatggagtctgggggaggctcggtgcaggctggagggtctctgagactctcctgtgcagcctctggattctcctacagtaacatctgtatgggctggttccgccaggctccagggaaggagcgcgagggggtcgcggctatttatagtaatggtagcacaatctacgcagactccgtgaagggccgattcaccgtctccaaagaattcgccaagaacactcagtatctgcaaatgaacagcctgaaacctgaggacactgccatgtactactgtgcggcaggccggtgtgggggccctaactactggggccaggggacccaggtcaccgtctcctca

SEQ ID NO: 283 - DNA, 396 bp, Artificial Sequence
  AS65183 sdAb
gaggtgcaactggcggagtctgggggaggctcggcgcaggctggagggtctctgagactctcctgtgcaagcaatgggtactacaaccgtcgctattgtatggcctggttccgccaggctccagggaaggagcgcgagggggtcgcgactatgactactactagtggtcgcacatactatgccgacgccgtgaagggccgattcaccgtctcccaagacaacgccaagtccacgctgtatctgcaaatgagcagcctgaaacctgaggacactgccatgtactactgtgcggcgcaccttcccagttcttgggtgacgtcgactgattactgcgacaacttgcaagccggcttttataactcctggggccaggggacccaggtcaccgtctcctca

SEQ ID NO: 284 - DNA, 348 bp, Artificial Sequence
  AS65062 sdAb
caggtgcacctggtggagtctgggggaggctcggtgcaggctggagggtctctgagactctcctgtgcagcctctggagtcagcgtggttaacttcgccatgaggtggtaccgccaggctccagggaacgagcgcgagttcgtctcagcgatgtaccgttctggtagcacgtcttacgctgactccgtgaggggccgattcaccatctcccgagacagcgccttgaacacggtgtttcttcaaatgagcggcctgaaacctgaggacacggccacgtattactgtcaagcgacatcacctatgggcgacacctactggggccaggggacccaggtcaccgtctcctca

SEQ ID NO: 285 - DNA, 363 bp, Artificial Sequence
  AS65065 sdAb
gaggtgcaactggcggagtctgggggaggctcggtgcaggctggagggtctctgagactctcctgtgcagcctctggatacagctactgtaggtccaccatgcgctggtaccgccaggctccagggaacgtgcgcgaatttgtctcagctatctatagtgatggtaccacaagctacacagactccgtgaagggccgattcaccatctcccaagacaacgccaagaacactgtgtatctacaaatgaacagcctgcaacctgaagacacggccatgtattactgtcggatagatcttgtcggatgcaacgtagctggtggcagtccttactggggccaggggacccaggtcaccgtctcctca

SEQ ID NO: 286 - DNA, 345 bp, Artificial Sequence
  AS65556 sdAb
caggtgcacctggtggagtctgggggaggctcggtgcaggttggagggtctctgagactctcctgtgcagcctctggatacaacgcctctatctgccgcatgagctggtaccgccaggctcccgggactgagcgcgagttcgtctcatcgtcttacagggatggtagccaaagctacgcagactccgtgaaggggcgattcaccacatcccgagactccgccaagaacacggtgtttctgcaaatgaacagcctgaaaccttcggacacggccatgtattactgtaacgcagcttgcccctggcgggcctactggggccaggggacccaggtcaccgtctcctca

SEQ ID NO: 287 - DNA, 348 bp, Artificial Sequence
  AS65069 sdAb
caggtgcacctggtggagtctgggggaggctcggtgcaggctggagggtctctgagactctcctgtgtagcctctggagacaccggctaccaacctacgatgaggtggtaccgccaggctccagggaaggagcgcgagttcgtctccgctatttatagtgatcagaccacaagctatgcagactccgtgaagggccggttcaccatctcccaagacaacgccagaaaaacggtgtatctgcaaatggctagcctgaaacctgaggacacggccatgtattactgtaaactcactactcgcagggggtctgagtactggggccaggggacacaggtcaccgtctcctca

SEQ ID NO: 288 - DNA, 348 bp, Artificial Sequence
  AS65691 sdAb
cagatgcagctggtggagtctgggggaggctcggtgcaggctggagggtctctgagactctcctgtacagtctctggatacaccgactataggctcgtactgaggtggtaccgccaggctctagggaaggagcgcgagttcatctcagctatttatagtgatggagtcacaagctactcagactccgtgaagggccgattcaccatctcccgagacaacgccaagaacacggcgtatctgcaaatgaacagcctgaaatctgaggacacggccatgtattactgtaaagcaaccgggtccggtggcgttgcctactggggccagggaacccaggtcaccgtctcctca

SEQ ID NO: 289 - DNA, 402 bp, Artificial Sequence
  AS65064 sdAb
caggttcagctggtggagtctgggggaggctcggtgcaggctggagggtctctgaaactctcctgtgcagtctctggagacaccgtccagactaactgtatggcctggttccgccaggctccagggaaggagcgcgaggcggtcgccagcattttgagtctttattctagtggaggtaagacagtctatgccgactccgtgaagggccgattcaccatctccccagacaacgcccagaacacggtgtcgctgcaaatgaacaatttgaaacctgaggacactgccatgtactactgtgcgactgtccgcgtgaccgtcacttgggccgaaaagttgaggcgttgtaccggattcagcggcatggactactggggcaaaggaaccctggtcaccgtctcctca

SEQ ID NO: 290 - DNA, 384 bp, Artificial Sequence
  AS65081 sdAb
caggtgcacctgatggagtctgggggaggctcggtgcaggctggagggtctctgagactctcctgtgcagcctctggagtccccgctagtagctactgcatgggctggttccgccaggctccagggaaggagcgcgagggggtcgcaggtattgtcagtgatactaccacaacctacgcagactccgtgaagggccgattcaccatctccaaagacaacgccaagaacactctgtatctgcaaatgaacagcctgaaacctgaggacactgccacgtactactgtgcggcctcccattttctattgtgcgccagaaaaccccgctgggatgacctcattaaatatgagtactggggccaggggacccaggtcaccgtctcctca

SEQ ID NO: 291 - DNA, 357 bp, Artificial Sequence
  AS65115 sdAb
caggttcagctggtggagtctgggggaggctcggtgcaggctggagggtctctgcgactctcctgtgcagcctctggatacatttacggctgcatgggctggttccgccgggctccagggaaggcgcgcgaggaggttgcgactatttaccgcgatggtacagcatactacgcaaactccgtagagggccgattcaccgcctccagaaacaacgccgagaacactctgtctctggagatgaacagtctgaacgctgaggacactgccatgtactactgtgcggcaagaacaactggttgtaactgggacatatctggggtttactggggccaggggacccaggtcaccgtctcctca

SEQ ID NO: 292 - DNA, 378 bp, Artificial Sequence
  AS65271 sdAb
cagatgcagctggtggagtctgggggaggctcggtgcaggctggagggtctctgacactctcctgtgcagcctctggaaaaacctacggacgctgcatggcctggttccgccaggctccagggaaggagcgcgagttagtcgctgctacttatattagtggtgggcgaccctacgttgccgactccgtgaagggccgattcaccatttcccgggacaacgccaagagtacgatgtctctgcaaatgaacagcctgagacctgacgacagcgccatgtactactgtgcggcgggttcggcgggtcggggaccttgtgatcgcttcgaccaaaatcaatataccttctggggccaggggacccaggtcaccgtctcctca

SEQ ID NO: 293 - DNA, 384 bp, Artificial Sequence
  AS65166 sdAb
caggtgcagctggtggagtctgggggaggctcggtgcaggctggagggtctctgagactctcctgtacagcctctgaagacttatctatttacggttacaattgcatgggctggttccgccaggctccagggaaggagcgcgaggcggtcgcagctatttatactggccgtggtaccacatactatgccgactccgtgaagggccgattcaccatctcccaagacaacgccaagaacactgtgtatctgcaaatgaacagcctgaaacctgaggacactgccatgtactactgtgcgtcaaaatactgtgcggtggtagctgatttcgggaattctcgactcgttcgttactggggccaggggacccaggtcaccgtctcctca

SEQ ID NO: 294 - DNA, 378 bp, Artificial Sequence
  AS65450 sdAb
caggtgaggttagtggagtctgggggaggctcggtgcaggctggagggtctctgagactctcctgtgcagcctctggagacatgaacggttacaagtgcatggggtggttccgccaggctccagggaaggagcgcgaggcggtcgcaggtatttatactggccgtgggaccacatactatgccgactccgtgaaggaccgattcaccatctcccaagacaacgccaagaacactgtgtatctgcaaatgaacagcctgaaacctgaggacactgccatgtactactgtgcagcaaaatactgtgcggtggtagctgaattcgggggtcctcgactcgttcgttactggggccaggggacccaggtcaccgtctcctca

SEQ ID NO: 295 - DNA, 378 bp, Artificial Sequence
  AS65454 sdAb
caggtgaggttggtggagtctgggggaggctcggtgcaggctggagggtctctgagactgtcctgtgcagcctctggagacatgaacggttacaagtgcatggggtggttccgccaggctccagggaaggagcgagaggcggtcgcaggtatttatactggccgtaatactacatactatgccgactccgtgaaggacctattcaccatctcccaagacaacgcctagaacactgtgtttctgcaaatgaacagcctgaaacctgaggacactgccatgtactactgtgcgtcataatactgtgcggtggtagctgaattccggggtcctcgactcgatcgttactggggctatgggacccaggtcaccgtcacctca

SEQ ID NO: 296 - DNA, 369 bp, Artificial Sequence
  AS65131 sdAb
gaggtgcagctggcggagtctgggggaggctcggtgcaggctggagggtctctgacactctcctgtacagcctctgaatacgtcacacacttgggctggttccgccaggctccagggaaggagcgcgagggggtcgcaatcgaaagttttcgtattggttatacatactatgccgactccgtgaagggtcgattcaccatctcccacgacaacgccaagaacacgctgtatctgcaaatgaacagcctgaaacctgaggacactgccatatactactgtgcggctcggcaggaccgatcgggggcttccatggtaaatcgagattcatataattactggggcaaggggacccaggtcaccgtctcctca

SEQ ID NO: 297 - DNA, 387 bp, Artificial Sequence
  AS65182 sdAb
caggtgaagttagtggagtcagggggaggctcggtgcaggctggagggtctctgagactctcctgtgcagcgtctggatacacgtacagttacggctacatgggctggttccggcaggctccagggaaggagcgcgagggggtcgcaaagatttataatggtgacggtagtacatactatgccgactccgtgaagggccgattcaccatctcccaagaccgccgcaacaacacgctgtatctgcaaatgaacagtctggcacctgaggacactggcatgtactactgtgcgacaaaccgactcccaaatagcgacgttgacttggtccttccccggttcggccgttttggttactggggccaggggacccaggtcaccgtctcctca

SEQ ID NO: 298 - DNA, 384 bp, Artificial Sequence
  AS60685 sdAb
caggtgcagctggtggagtctgggggaggctcggtgcaggctggagggtctctgagactctcctgtgcagcctctggtaatgtctacaataacatgtgcatgggctggttccgccaggctccagggaaggagcgcgagggggtcgcaagtatgtatgttggtggtggttacacctactatgacgactccgtgaagggccgattcaccatctcccgagacaacgccaagaacacgctgtatctgcaaatgaacagcctgaaacctgaagacactgccatgtactactgtgcggcaatctccatcgcgcttacgagggaattctgcgccccgatcgtttctcggtataattattggggccaggggacccaggtcaccgtctcctca

SEQ ID NO: 299 - DNA, 384 bp, Artificial Sequence
  AS60702 sdAb
caggtgaagttggtggagtctgggggaggctcggtgcaggctggagggtctctgagactctcatgtgcagcctctggaaacgtctacaataacatgtgcatgggctggttccgccaggctccagggaaggagcgcgagggggtcgcaagtatctatgttggtggtggttacaccaactatgccgactccgtgaggggccgattcaccatctcccaagacaacgccaagaacacgctgtatctgcaaatgaacagcctgaaacctgaggacactgccatgtactactgtgcggcaattaccgtcgcgcttacgagggctttctgcgccccgatcccttctcggtataccaactggggccaggggacccaggtcaccgtctcctca

SEQ ID NO: 300 - DNA, 375 bp, Artificial Sequence
  AS60705 sdAb
caggtgcagctggtggagtctgggggaggctcggtgcagtctggagggtctctgagactctcctgtgcagcctctggatacgcctacagtgggtcttgcatgatggcctggttccgccaggctccagggaaggagcgcgagggggtcgcagttagcgttcgtcgtacgggaagcgcattctatgccgactccgtgaaggcccgattcaccatctcccgcgacaatgccaagaacacgctgtatctgcaaatgaataacctgaaagttgaggacactgccatgtactactgtgcggcagattttacttgtcgtacgtggactctcaataaaaattacaaccactggggccaggggacccaggtcaccgtctcctca

SEQ ID NO: 301 - DNA, 348 bp, Artificial Sequence
  AS60660 sdAb
caggtgcacctgatggagtctgggggaggctcggtgcaggctggagggtctctgagactctcctgtgtagcctctggagacaccggctaccaacctacgatgaggtggtaccgccaggctccagggaaggagcgcgagttcgtctccgctatttatagtgatcagaccacaagctatgcagactccgtgaagggccggttcaccatctcccaagacaacgccagaaaaacggtgtatctgcaaatggctagcctgaaacctgaggacacggccatgtattactgtaaactcactactcgcagggggtctgagtactggggccaggggacacaggtcaccgtctcctca

SEQ ID NO: 302 - DNA, 363 bp, Artificial Sequence
  AS60662 sdAb
caggtgcacctggtggagtctgggggaggctcggtgcaggctggagggtctctgagactctcctgtgtagcctctggatacaggaactgtaggtccaccatgcgctggtaccgccagggtccaggacaggtgcgagactgggtctcaagtatctatactgatggtaccacaagctacacagactccgtgaagggccgattcaccatcgcccaagacaaaggcaagaacacggtgtatctacaaatgaacagcctgcaacctgaagacacggccatgtattactgtcggatagatcttgtcggatgcaatgtagctggtggcagtccttactggggccatgggacccaggtcaccgtctcctca

SEQ ID NO: 303 - DNA, 378 bp, Artificial Sequence
  AS60664 sdAb
caggtgcacctggtggagtctgggggaggctcggtgcaggctggagggtctctgacactctcctgtgcagcctctggaaaaacctacggacgctgcatggcctggttccgccaggctccagggaaggagcgcgagttagtcgctgctacttatattagtggtgggcgaccctacgttgccgactccgtgaagggccgattcaccatttcccgggacaacgccaagagtacgatgtctctgcaaatgaacagcctgagacctgacgacagcgccatgtactactgtgcggcgggttcggcgggtcggggaccttgtgatcgcttcgaccaaaatcaatataccttctggggccaggggacccaggtcaccgtctcctca

SEQ ID NO: 304 - DNA, 378 bp, Artificial Sequence
  AS60668 sdAb
caggtgcacctggtggagtctgggggaggctcggtgcaggctggagggtctctgagactgtcctgtgcagcctctggagacatgaacggttacaagtgcatggggtggttccgccaggctccagggaaggagcgcgaggcggtcgcaggtatttatactggccgtaatactacatactatgccgactccgtgaaggaccgattcaccatctcccaagacaacgccaagaacactgtgtttctgcaaatgaacagcctgaaacctgaggacactgccatgtactactgtgcgtcaaaatactgtgcggtggtagctgaattcgggggtcctcgactcgttcgttactggggccaggggacccaggtcaccgtctcctca

SEQ ID NO: 305 - DNA, 360 bp, Artificial Sequence
  AS60676 sdAb
caggtgcagctggtggagtctgggggagggtcggtgcaggctggagggtctctgagactctcctgcgcagcctctggatacaccgtcagtagcggctgcatgggctggttccgccaggctccagggaaggagcgcgagcgggtcgcacagattggtcgtgatgctaccacgacctacgcagactccgtgaagggccgattcaccatcgccagagacgacgccgagaacactctgtatctgcaaatgaacagcctgaaacctgaagacactgccatgtacagctgtacggcctattggggtgtatactgtttatctccaggacgctactggggccaggggacccaggtcaccgtctcctca

SEQ ID NO: 306 - DNA, 372 bp, Artificial Sequence
  AS60678 sdAb
caggtgcacctggtggagtctgggggaggctcggtgcaggctggagggtctctgagactctcctgtgcagtctctggatacacctccagtcgcggttgcatgagctggttccgccaggctccagggaaggagcgcgagagggtcgcatacattaatatgcgtgtcctaaccacaatctatgccgcctccgtgaaggaccgattcgccatctccagagacaacgccaagaacacggtggatctgcaaatgaacaacctgaaacctgaggacactgccatgtactactgcgcggcggggtacaatggacaatggtgcgaacatgctagtgacgttactgcctggggtcaggggacccaggtcaccgtctcctca

SEQ ID NO: 307 - DNA, 348 bp, Artificial Sequence
  AS60679 sdAb
caggtgcacctgatggagtctgggggaggctcggtgcaggctggagggtctctgagactctcctgtgcacgctctggagtcacctattgtaggttgaccatgaggtggtaccgccaggctccagggagcgagcgcgagttcgtctccgctatttatagtgatggtagcacagcctacgcagactccgtgaagggtcgattcaccatgtcccaagacgacgccaagaacacggtgtatctgcaaatgaacagcgtgaaacctgaggacacggccatgtattattgtaaattgaattgtgcgtccggcttgactgcctggggccaggggacccaggtcaccgtctcctca

SEQ ID NO: 308 - DNA, 372 bp, Artificial Sequence
  AS81326 sdAb
gaggtgcagctggtggagtctgggggaggctcggtgcaggctggagggtctctgacactctcctgtgcagcctccgagagtagggattgtatggcctggttccgccaggctccagggaaggcgcgcgagggggtcgcatctatttatgctccggatggtagcacaacctatgccgacaccgtgaagggccgattcaccatctcccaagacaacgccaagaacacgctgtatctgcaaatgaacagcctgcaacctgaggacgctgccatgtaccactgtgcgatcggggggctgtcacgcaatacttgtggttacctcagaggcggatactttgcttactttggccgggggacccaggtcaccgtctcctca

SEQ ID NO: 309 - DNA, 390 bp, Artificial Sequence
  AS81187 sdAb
caggtgaggttggtggagtctgggggcggctcggtgcaggctggagggtctctgagactctcctgtgcagcctctggatacacctacagcagctacagtagcaactgcctgggctggttccgccaggctccagggaaggagcgcgaggcagtcgcacgtatctatcctaacagtggtagcacatactatgccgactccgtgaagggccgcttcaccatctcccaagacaacgccaagaacacggtgtatctacaaatgaacagcctgaaacctgaggacactgccatgtactactgtgcggtagcagtgggagtcggtgataattggtgtgcgtcaggggccgcatactttggttactggggccaggggacccaggtcaccgtctcctca

SEQ ID NO: 310 - DNA, 375 bp, Artificial Sequence
  AS80533 sdAb
caggtgcacctggtggagtctgggggaggctcggtgcagactggagggtctctaagactctcctgtacagcctctggactcagcttcagtacctacacggtggcctggttccgccaggctccaggaaaggagcgcgagggggtcgcggctattccatatactagtcaacacatggtctataccgactccgtgaagggccgattcaccatctcccgagacaacacaaagaacatggtgtatctgcaaatgaacagcctgaaaccggaggacaccgccatgtactactgtgcgacagatcggcgccctggaacgagtatgttggctataaatgggtataaccgctggggccaggggacccaggtcaccgtctcctca

SEQ ID NO: 311 - DNA, 375 bp, Artificial Sequence
  AS80444 sdAb
gaggtgcagctggcggagtctgggggaggctcggtgcaggctggagggtctctgagactctcctgtgcagcctctggattcaccttcagtcgcaacacgatgggctggttccgccaggctccagggaaggagcgcgagggggtcgcggctattccatatactagtactggcatagtctattccgactccgtgggcggccgattcaccatctcccgagacaacacaaagaacatggtgtatctgcaaatgaacaacctggaaccggaggacactgccatgtactactgtgcgacagatcggcgccctggaacgactatgttggcggtaaatgggtataaccactggggccaggggacccaggtcaccgtctcctca

SEQ ID NO: 312 - DNA, 375 bp, Artificial Sequence
  AS81487 sdAb
caggtgaggttggtggagtctgggggaggctcggtgcaggctggagggtctctgagagtctcctgtttagtctctaaactcaccgcatggcgcagctgcgtgggctggttccgccaggctccagggaaggagcgcgagggggtcgcagctatatattctggtactggtagtacatactatgccgactccgtgaagggccgattcaccatcgcccaagactacgccaagaacatggtgtacttgcaaatgaacagcctgaaacctgaagacactgccatgtactactgtgcgggcacgtcgatacgcagcagttgtggcttagtgcgcgatgaatacgcctactggggccaggggacccaggtcaccgtctcctca

SEQ ID NO: 313 - protein, 239 aa, Artificial Sequence
  SS1 scFv
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 314 - protein, 241 aa, Artificial Sequence
  M5 scFv
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 315 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 316 - protein, 623 aa, Cynomolgus
MALPMARPLSGSCGTPALGSLLFLLFSLGWVQPSRVLAGETRQVRSPLGKPGRVFSLSPRQLLGFTCVEVSGLSTELVQELAVALGQKNVKLSAEQLRCLAHQLSEPPEDLDALPLDLLLFLNPDAFSGPQACTHFFSRVAKANVDLLPRGAPERQRLLPAALTCWGVRGSLLSEADVRALGGLACDLPGRFVAESAEVVLPRLVRCLGPLDQDQQEAARAALQRGGPPYGPPSTWSISTLDDLQSLLPVLGQPVIHSIPQGILAAWRQRSSRDPSWQQPEQTVLRPRFRRDVERTTCPPEKEVHEIDESLIFYKKRELEACVDPALLAAQMDRVDAIPFTYEQLDVLKHKLDELYPQGYPESVIRHLGHLFLKMSPEDIRKWNVTSLETLKALLKVSKGHEMSAQWPVPQVATLIDRVVVGRGQLDKDTVDTLTAFCPGCLCSLSPERLSSVPPSVIGAVRPQDLDTCGPRQLDVLYPKARLAFQNMSGSEYFVKIRPFLGGAPTEDVKALSQQNVSMDLATFMKLRREAVLPLTVAEVQKLLGPHVEGLKVEEQHSPVRDWILKQRQDDLDTLGLGLQGGIPNGYLILDLSVREALSGTPCLLGPGPVLTVLALLLASTLA

SEQ ID NO: 317 - protein, 295 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRR

SEQ ID NO: 318 - protein, 327 aa, Homo sapiens
EVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 319 - protein, 21 aa, Artificial Sequence
  FSHbeta 33-53
YTRDLVYKDPARPKIQKTCTF

SEQ ID NO: 320 - protein, 16 aa, Artificial Sequence
  FSHbeta 51-65
CTFKELVYETVRVPGC

SEQ ID NO: 321 - protein, 15 aa, Artificial Sequence
  FSHbeta 81-95
QCHCGKCDSDSTDCT

SEQ ID NO: 322 - protein, 26 aa, Artificial Sequence
  FSHbeta 87-94 + FSHbeta 25-42
CDSDSTDCILQCMGCCFSRAYPTPLR

SEQ ID NO: 323 - protein, 45 aa, Artificial Sequence
  FSHbeta 87-94 + FSHbeta 25-42 + FSHbeta 27-45
CDSDSTDCILQCMGCCFSRAYPTPLRWCAGYCYCYTRDVKDPARP

SEQ ID NO: 324 - protein, 19 aa, Artificial Sequence
  Anti-FSHR peptide 33-53
YTRDLVYKDPARPKIQKTC

SEQ ID NO: 325 - protein, 15 aa, Artificial Sequence
  Anti-FSHR peptide 51-65
KTCTFKELVYETVRV

SEQ ID NO: 326 - protein, 19 aa, Artificial Sequence
  Anti-FSHR peptide 81-95
GSQCHCGKCDSDSTDCTAS

SEQ ID NO: 327 - protein, 30 aa, Artificial Sequence
  Anti-FSHR antagonist A
GSCDSDSTDCILQCMGCCFSRAYPTPLRAS

SEQ ID NO: 328 - protein, 30 aa, Artificial Sequence
  Anti-FSHR antagonist B
GSRLPTPYARSFCCGMCQLICDTSDSDCAS

SEQ ID NO: 329 - protein, 50 aa, Artificial Sequence
  Anti-FSHR agonist A
GSCDSDSTDCILQCMGCCFSRAYPTPLRWCAGYCYCYTRDLVKDPARPAS

SEQ ID NO: 330 - protein, 46 aa, Artificial Sequence
  Anti-FSHR agonist B
PRAPDKVLDRTYCYCYGACWRLPTPYARSFCCGMCQLICDTSDSDC

SEQ ID NO: 331 - protein, 207 aa, Artificial Sequence
  Anti-FSHR peptide alpha + beta
GSNSCELTNITIAIEKEECRFCISINTTWCAGYCYTRDLVYKDPARPKIQKTCTFKELVYETVRVPGCAHHADSLYTYPVATQCHCGKCDSDSTDCTVRGLGPSYCSFGEMKEAPDVQDCPECTLQENPFFSQPGAPILQCMGCCFSRAYPTPLRSKKTMLVQKNVTSESTCCVAKSYNRVTVMGGFKVENHTACHCSTCYYHKSAS

SEQ ID NO: 332 - protein, 253 aa, Artificial Sequence
  Fc Fusion FSHbeta 33-53
YTRDLVYKDPARPKIQKTCTFEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 333 - DNA, 759 bp, Artificial Sequence
  Fc Fusion FSHbeta 33-53
tacacccgggacctggtgtataaggatcccgccagacctaagatccagaagacctgcacattcgagcccaagtcctgtgataagacccacacatgccccccttgtcctgctccagagctgctgggcggccctagcgtgttcctgtttccacccaagcctaaggacaccctgatgatctctcggaccccagaggtgacatgcgtggtggtggacgtgagccacgaggatcccgaggtgaagtttaactggtatgtggatggcgtggaggtgcacaatgccaagaccaagcccagagaggagcagtacaactccacctatagggtggtgtctgtgctgacagtgctgcaccaggactggctcaacggcaaggagtataagtgcaaggtgtccaataaggccctgcccgcccctatcgagaagaccatctctaaggccaagggccagcctcgggagccacaggtgtacacactgcctccatccagagacgagctgaccaagaaccaggtgtctctgacatgtctggtcaagggcttctatccctctgatatcgccgtggagtgggagagcaatggccagcctgagaacaattacaagaccacaccccctgtgctggactccgatggctctttctttctgtatagcaagctgaccgtggataagtcccggtggcagcagggcaacgtgttcagctgttccgtgatgcacgaggcactgcacaaccattacacccagaagtcactgtcactgtccccaggcaag

SEQ ID NO: 334 - protein, 5 aa, Artificial Sequence
  Linker
GGGGS

SEQ ID NO: 335 - protein, 10 aa, Artificial Sequence
  Linker
GGGGSGGGGS

SEQ ID NO: 336 - protein, 15 aa, Artificial Sequence
  Linker
GGGGSGGGGSGGGGS

SEQ ID NO: 337 - protein, 20 aa, Artificial Sequence
  Linker
GGGGSGGGGSGGGGSGGGGS

SEQ ID NO: 338 - protein, 25 aa, Artificial Sequence
  Linker
GGGGSGGGGSGGGGSGGGGSGGGGS

SEQ ID NO: 339 - DNA, 1335 bp, Artificial Sequence
  EF1alpha promoter
gagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 340 - protein, 21 aa, Artificial Sequence
  CD8alpha signal peptide
MALPVTALLLPLALLLHAARP

SEQ ID NO: 341 - protein, 45 aa, Artificial Sequence
  CD8alpha hinge domain
TTTPAPRPPTPAPTIASQPLSLRPEACRPAAGGAVHTRGLDFACD

SEQ ID NO: 342 - protein, 24 aa, Artificial Sequence
  CD8alpha transmembrane domain
IYIWAPLAGTCGVLLLSLVITLYC

SEQ ID NO: 343 - protein, 42 aa, Artificial Sequence
  CD137 intracellular domain
KRGRKKLLYIFKQPFMRPVQTTQEEDGCSCRFPEEEEGGCEL

SEQ ID NO: 344 - protein, 41 aa, Artificial Sequence
  CD28 intracellular domain
RSKRSRLLHSDYMNMTPRRPGPTRKHYQPYAPPRDFAAYRS

SEQ ID NO: 345 - protein, 112 aa, Artificial Sequence
  CD3alpha intracellular domain
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 346 - protein, 22 aa, Artificial Sequence
  P2A element
GSGATNFSLLKQAGDVEENPGP

SEQ ID NO: 347 - protein, 199 aa, Artificial Sequence
  dnTGFbetaRII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 348 - protein, 281 aa, Artificial Sequence
  FSHbeta 33-53 + AD58126VH3VL1 scFV tandem
YTRDLVYKDPARPKIQKTCTFGGGGSGGGGSGGGGSQVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIK

SEQ ID NO: 349 - protein, 277 aa, Artificial Sequence
  FSHbeta 33-53 + AS51489 scFV tandem
YTRDLVYKDPARPKIQKTCTFGGGGSGGGGSGGGGSEVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIK

SEQ ID NO: 350 - protein, 276 aa, Artificial Sequence
  FSHbeta 33-53 + AD92110 scFV tandem
YTRDLVYKDPARPKIQKTCTFGGGGSGGGGSGGGGSEVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIK

SEQ ID NO: 351 - protein, 274 aa, Artificial Sequence
  FSHbeta 33-53 + AS91156 scFV tandem
YTRDLVYKDPARPKIQKTCTFGGGGSGGGGSGGGGSEVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIK

SEQ ID NO: 352 - protein, 274 aa, Artificial Sequence
  FSHbeta 33-53 + AS91189 scFV tandem
YTRDLVYKDPARPKIQKTCTFGGGGSGGGGSGGGGSEVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIK

SEQ ID NO: 353 - protein, 277 aa, Artificial Sequence
  FSHbeta 33-53 + AS51674 scFV tandem
YTRDLVYKDPARPKIQKTCTFGGGGSGGGGSGGGGSEVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIK

SEQ ID NO: 354 - protein, 158 aa, Artificial Sequence
  FSHbeta 33-53 + AS65233 sdAb tandem
YTRDLVYKDPARPKIQKTCTFGGGGSGGGGSGGGGSQVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSS

SEQ ID NO: 355 - protein, 164 aa, Artificial Sequence
  FSHbeta 33-53 + AS60685 sdAb tandem
YTRDLVYKDPARPKIQKTCTFGGGGSGGGGSGGGGSQVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSS

SEQ ID NO: 356 - protein, 164 aa, Artificial Sequence
  FSHbeta 33-53 + AS60702 sdAb tandem
YTRDLVYKDPARPKIQKTCTFGGGGSGGGGSGGGGSQVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSS

SEQ ID NO: 357 - protein, 156 aa, Artificial Sequence
  FSHbeta 33-53 + AS60676 sdAb tandem
YTRDLVYKDPARPKIQKTCTFGGGGSGGGGSGGGGSQVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSS

SEQ ID NO: 358 - protein, 489 aa, Artificial Sequence
  AD58126VH3VL1 CAR
MALPVTALLLPLALLLHAARPQVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 359 - protein, 485 aa, Artificial Sequence
  AS51489 CAR
MALPVTALLLPLALLLHAARPEVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 360 - protein, 484 aa, Artificial Sequence
  AS92110 CAR
MALPVTALLLPLALLLHAARPEVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 361 - protein, 482 aa, Artificial Sequence
  AS91156 CAR
MALPVTALLLPLALLLHAARPEVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 362 - protein, 482 aa, Artificial Sequence
  AS91189 CAR
MALPVTALLLPLALLLHAARPEVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 363 - protein, 485 aa, Artificial Sequence
  AS51674 CAR
MALPVTALLLPLALLLHAARPEVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 364 - protein, 366 aa, Artificial Sequence
  AS65233 CAR
MALPVTALLLPLALLLHAARPQVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 365 - protein, 372 aa, Artificial Sequence
  AS60685 CAR
MALPVTALLLPLALLLHAARPQVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 366 - protein, 372 aa, Artificial Sequence
  AS60702 CAR
MALPVTALLLPLALLLHAARPQVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 367 - protein, 364 aa, Artificial Sequence
  AS60676 CAR
MALPVTALLLPLALLLHAARPQVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 368 - protein, 483 aa, Artificial Sequence
  SS1 CAR
MALPVTALLLPLALLLHAARPQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 369 - protein, 485 aa, Artificial Sequence
  M5 CAR
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 370 - protein, 525 aa, Artificial Sequence
  FSHbeta 33-53 + AD58126VH3VL1 tandem CAR
MALPVTALLLPLALLLHAARPYTRDLVYKDPARPKIQKTCTFGGGGSGGGGSGGGGSQVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 371 - protein, 521 aa, Artificial Sequence
  FSHbeta 33-53 + AS51489 tandem CAR
MALPVTALLLPLALLLHAARPYTRDLVYKDPARPKIQKTCTFGGGGSGGGGSGGGGSEVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 372 - protein, 520 aa, Artificial Sequence
  FSHbeta 33-53 + AS92110 tandem CAR
MALPVTALLLPLALLLHAARPYTRDLVYKDPARPKIQKTCTFGGGGSGGGGSGGGGSEVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 373 - protein, 518 aa, Artificial Sequence
  FSHbeta 33-53 + AS91156 tandem CAR
MALPVTALLLPLALLLHAARPYTRDLVYKDPARPKIQKTCTFGGGGSGGGGSGGGGSEVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 374 - protein, 518 aa, Artificial Sequence
  FSHbeta 33-53 + AS91189 tandem CAR
MALPVTALLLPLALLLHAARPYTRDLVYKDPARPKIQKTCTFGGGGSGGGGSGGGGSEVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 375 - protein, 521 aa, Artificial Sequence
  FSHbeta 33-53 + AS51674 tandem CAR
MALPVTALLLPLALLLHAARPYTRDLVYKDPARPKIQKTCTFGGGGSGGGGSGGGGSEVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 376 - protein, 402 aa, Artificial Sequence
  FSHbeta 33-53 + AS65233 tandem CAR
MALPVTALLLPLALLLHAARPYTRDLVYKDPARPKIQKTCTFGGGGSGGGGSGGGGSQVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 377 - protein, 408 aa, Artificial Sequence
  FSHbeta 33-53 + AS60685 tandem CAR
MALPVTALLLPLALLLHAARPYTRDLVYKDPARPKIQKTCTFGGGGSGGGGSGGGGSQVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 378 - protein, 408 aa, Artificial Sequence
  FSHbeta 33-53 + AS60702 tandem CAR
MALPVTALLLPLALLLHAARPYTRDLVYKDPARPKIQKTCTFGGGGSGGGGSGGGGSQVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 379 - protein, 400 aa, Artificial Sequence
  FSHbeta 33-53 + AS60676 tandem CAR
MALPVTALLLPLALLLHAARPYTRDLVYKDPARPKIQKTCTFGGGGSGGGGSGGGGSQVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 380 - protein, 775 aa, Artificial Sequence
  AD58126VH3VL1 + FSHbeta 33-53 dual CAR
MALPVTALLLPLALLLHAARPQVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 381 - protein, 771 aa, Artificial Sequence
  AS51489 + FSHbeta 33-53 dual CAR
MALPVTALLLPLALLLHAARPEVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 382 - protein, 770 aa, Artificial Sequence
  AS92110 + FSHbeta 33-53 dual CAR
MALPVTALLLPLALLLHAARPEVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 383 - protein, 768 aa, Artificial Sequence
  AS91156 + FSHbeta 33-53 dual CAR
MALPVTALLLPLALLLHAARPEVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 384 - protein, 768 aa, Artificial Sequence
  AS91189 + FSHbeta 33-53 dual CAR
MALPVTALLLPLALLLHAARPEVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 385 - protein, 771 aa, Artificial Sequence
  AS51674 + FSHbeta 33-53 dual CAR
MALPVTALLLPLALLLHAARPEVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 386 - protein, 652 aa, Artificial Sequence
  AS65233 + FSHbeta 33-53 dual CAR
MALPVTALLLPLALLLHAARPQVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 387 - protein, 658 aa, Artificial Sequence
  AS60685 + FSHbeta 33-53 dual CAR
MALPVTALLLPLALLLHAARPQVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 388 - protein, 658 aa, Artificial Sequence
  AS60702 + FSHbeta 33-53 dual CAR
MALPVTALLLPLALLLHAARPQVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 389 - protein, 650 aa, Artificial Sequence
  AS60676 + FSHbeta 33-53 dual CAR
MALPVTALLLPLALLLHAARPQVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 390 - protein, 710 aa, Artificial Sequence
  AD58126VH3VL1 CAR with dnTGFbetaRII
MALPVTALLLPLALLLHAARPQVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 391 - protein, 706 aa, Artificial Sequence
  AS51489 CAR with dnTGFbetaRII
MALPVTALLLPLALLLHAARPEVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 392 - protein, 705 aa, Artificial Sequence
  AS92110 CAR with dnTGFbetaRII
MALPVTALLLPLALLLHAARPEVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 393 - protein, 703 aa, Artificial Sequence
  AS91156 CAR with dnTGFbetaRII
MALPVTALLLPLALLLHAARPEVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 394 - protein, 703 aa, Artificial Sequence
  AS91189 CAR with dnTGFbetaRII
MALPVTALLLPLALLLHAARPEVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 395 - protein, 706 aa, Artificial Sequence
  AS51674 CAR with dnTGFbetaRII
MALPVTALLLPLALLLHAARPEVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 396 - protein, 587 aa, Artificial Sequence
  AS65233 CAR with dnTGFbetaRII
MALPVTALLLPLALLLHAARPQVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 397 - protein, 593 aa, Artificial Sequence
  AS60685 CAR with dnTGFbetaRII
MALPVTALLLPLALLLHAARPQVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 398 - protein, 593 aa, Artificial Sequence
  AS60702 CAR with dnTGFbetaRII
MALPVTALLLPLALLLHAARPQVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 399 - protein, 585 aa, Artificial Sequence
  AS60676 CAR with dnTGFbetaRII
MALPVTALLLPLALLLHAARPQVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 400 - protein, 746 aa, Artificial Sequence
  FSHbeta 33-53 + AD58126VH3VL1 tandem CAR with dnTGFbetaRII
MALPVTALLLPLALLLHAARPYTRDLVYKDPARPKIQKTCTFGGGGSGGGGSGGGGSQVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 401 - protein, 742 aa, Artificial Sequence
  FSHbeta 33-53 + AS51489 tandem CAR with dnTGFbetaRII
MALPVTALLLPLALLLHAARPYTRDLVYKDPARPKIQKTCTFGGGGSGGGGSGGGGSEVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 402 - protein, 741 aa, Artificial Sequence
  FSHbeta 33-53 + AS92110 tandem CAR with dnTGFbetaRII
MALPVTALLLPLALLLHAARPYTRDLVYKDPARPKIQKTCTFGGGGSGGGGSGGGGSEVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 403 - protein, 739 aa, Artificial Sequence
  FSHbeta 33-53 + AS91156 tandem CAR with dnTGFbetaRII
MALPVTALLLPLALLLHAARPYTRDLVYKDPARPKIQKTCTFGGGGSGGGGSGGGGSEVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 404 - protein, 739 aa, Artificial Sequence
  FSHbeta 33-53 + AS91189 tandem CAR with dnTGFbetaRII
MALPVTALLLPLALLLHAARPYTRDLVYKDPARPKIQKTCTFGGGGSGGGGSGGGGSEVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 405 - protein, 742 aa, Artificial Sequence
  FSHbeta 33-53 + AS51674 tandem CAR with dnTGFbetaRII
MALPVTALLLPLALLLHAARPYTRDLVYKDPARPKIQKTCTFGGGGSGGGGSGGGGSEVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 406 - protein, 623 aa, Artificial Sequence
  FSHbeta 33-53 + AS65233 tandem CAR with dnTGFbetaRII
MALPVTALLLPLALLLHAARPYTRDLVYKDPARPKIQKTCTFGGGGSGGGGSGGGGSQVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 407 - protein, 629 aa, Artificial Sequence
  FSHbeta 33-53 + AS60685 tandem CAR with dnTGFbetaRII
MALPVTALLLPLALLLHAARPYTRDLVYKDPARPKIQKTCTFGGGGSGGGGSGGGGSQVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 408 - protein, 629 aa, Artificial Sequence
  FSHbeta 33-53 + AS60702 tandem CAR with dnTGFbetaRII
MALPVTALLLPLALLLHAARPYTRDLVYKDPARPKIQKTCTFGGGGSGGGGSGGGGSQVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 409 - protein, 621 aa, Artificial Sequence
  FSHbeta 33-53 + AS60676 tandem CAR with dnTGFbetaRII
MALPVTALLLPLALLLHAARPYTRDLVYKDPARPKIQKTCTFGGGGSGGGGSGGGGSQVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 410 - protein, 996 aa, Artificial Sequence
  AD58126VH3VL1 + FSHbeta 33-53 dual CAR with dnTGFbetaRII
MALPVTALLLPLALLLHAARPQVQLVQSGAEVKKPGASVKVSCKASGYTFTSYWMHWVKQAPGQGLEWIGYINPSTGHTDYNQKFKDRATLTADTSTSTVYMELSSLRSEDTAVYYCARSNWAWFPYWGQGTLVTVSSGGGGSGGGGSGGGGSDIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSYPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 411 - protein, 992 aa, Artificial Sequence
  AS51489 + FSHbeta 33-53 dual CAR with dnTGFbetaRII
MALPVTALLLPLALLLHAARPEVQLVESGGGLVQPGGSLRLSCAASGFNLYYYSIHWVRQAPGKGLEWVAYISSSSSYTYYADSVKGRFTISADTSKNTAYLQMNSLRAEDTAVYYCARYYPYYGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGFSYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 412 - protein, 991 aa, Artificial Sequence
  AS92110 + FSHbeta 33-53 dual CAR with dnTGFbetaRII
MALPVTALLLPLALLLHAARPEVQLVESGGGLVQPGGSLRLSCAASGFNIYYSSMHWVRQAPGKGLEWVAYIYPYYSYTYYADSVKGRFTISADTSKNTAYLQMNSLRAEDTAVYYCARGYALDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQASSGYHYLITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 413 - protein, 989 aa, Artificial Sequence
  AS91156 + FSHbeta 33-53 dual CAR with dnTGFbetaRII
MALPVTALLLPLALLLHAARPEVQLVESGGGLVQPGGSLRLSCAASGFNIYSSSIHWVRQAPGKGLEWVASISSYSSYTSYADSVKGRFTISADTSKNTAYLQMNSLRAEDTAVYYCARYYAMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGPYYHPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 414 - protein, 989 aa, Artificial Sequence
  AS91189 + FSHbeta 33-53 dual CAR with dnTGFbetaRII
MALPVTALLLPLALLLHAARPEVQLVESGGGLVQPGGSLRLSCAASGFNLSYSSIHWVRQAPGKGLEWVASIYSYSGSTYYADSVKGRFTISADTSKNTAYLQMNSLRAEDTAVYYCARYWGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQYYWYYPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 415 - protein, 992 aa, Artificial Sequence
  AS51674 + FSHbeta 33-53 dual CAR with dnTGFbetaRII
MALPVTALLLPLALLLHAARPEVQLVESGGGLVQPGGSLRLSCAASGFNLYSYYMHWVRQAPGKGLEWVASIYSYSSYTSYADSVKGRFTISADTSKNTAYLQMNSLRAEDTAVYYCARPFGWGYAGMDYWGQGTLVTVSSGGGGSGGGGSGGGGSDIQMTQSPSSLSASVGDRVTITCRASQSVSSAVAWYQQKPGKAPKLLIYSASSLYSGVPSRFSGSRSGTDFTLTISSLQPEDFATYYCQQGYAPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 416 - protein, 873 aa, Artificial Sequence
  AS65233 + FSHbeta 33-53 dual CAR with dnTGFbetaRII
MALPVTALLLPLALLLHAARPQVHLVESGGGSVQAGGSLRLSCAASEFTYSMGWFRQAPGKEREGVAHIYTRGGTTVYADSVKGRFVLSRYNAKSIMYLQMNSVKLEDTAMYYCAARTIFEGSWSSPSSFDFWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 417 - protein, 879 aa, Artificial Sequence
  AS60685 + FSHbeta 33-53 dual CAR with dnTGFbetaRII
MALPVTALLLPLALLLHAARPQVQLVESGGGSVQAGGSLRLSCAASGNVYNNMCMGWFRQAPGKEREGVASMYVGGGYTYYDDSVKGRFTISRDNAKNTLYLQMNSLKPEDTAMYYCAAISIALTREFCAPIVSRYNYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 418 - protein, 879 aa, Artificial Sequence
  AS60702 + FSHbeta 33-53 dual CAR with dnTGFbetaRII
MALPVTALLLPLALLLHAARPQVKLVESGGGSVQAGGSLRLSCAASGNVYNNMCMGWFRQAPGKEREGVASIYVGGGYTNYADSVRGRFTISQDNAKNTLYLQMNSLKPEDTAMYYCAAITVALTRAFCAPIPSRYTNWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 419 - protein, 871 aa, Artificial Sequence
  AS60676 + FSHbeta 33-53 dual CAR with dnTGFbetaRII
MALPVTALLLPLALLLHAARPQVQLVESGGGSVQAGGSLRLSCAASGYTVSSGCMGWFRQAPGKERERVAQIGRDATTTYADSVKGRFTIARDDAENTLYLQMNSLKPEDTAMYSCTAYWGVYCLSPGRYWGQGTQVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSS

SEQ ID NO: 420 - protein, 122 aa, Artificial Sequence
  AS65233VH4
EVQLVESGGGLVQPGGSLRLSCAASEFTYSMGWFRQAPGKGLEGVSHIYTRGGTTVYADSVKGRFVLSRDNSKNTLYLQMNSLRAEDTAVYYCAARTIFEGSWSSPSSFDFWGQGTLVTVSS

SEQ ID NO: 421 - protein, 122 aa, Artificial Sequence
  AS65233VH5
EVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSS

SEQ ID NO: 422 - protein, 122 aa, Artificial Sequence
  AS65233VH6
EVQLVESGGGLVQPGGSLRLSCAASEFTYSMGWFRQAPGKGREGVAHIYTRGGTTVYADSVKGRFVLSRDNSKNTMYLQMNSLRAEDTAMYYCAARTIFEGSWSSPSSFDFWGQGTLVTVSS

SEQ ID NO: 423 - protein, 125 aa, Artificial Sequence
  AS80444VH4
EVQLVESGGGLVQPGGSLRLSCAASGFTFSRNTMGWFRQAPGKGLEGVSAIPYTSTGIVYSDSVGGRFTISRDNSKNTLYLQMNSLRAEDTAVYYCATDRRPGTTMLAVNGYNHWGQGTLVTVSS

SEQ ID NO: 424 - protein, 125 aa, Artificial Sequence
  AS80444VH5
EVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSS

SEQ ID NO: 425 - protein, 125 aa, Artificial Sequence
  AS80444VH6
EVQLVESGGGLVQPGGSLRLSCAASGFTFSRNTMGWFRQAPGKGREGVSAIPYTSTGIVYSDSVGGRFTISRDNSKNTVYLQMNSLRAEDTAMYYCATDRRPGTTMLAVNGYNHWGQGTLVTVSS

SEQ ID NO: 426 - protein, 125 aa, Artificial Sequence
  AS80533VH4
QVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSS

SEQ ID NO: 427 - protein, 125 aa, Artificial Sequence
  AS80533VH5
QVQLVESGGGVVQPGGSLRLSCAASGLSFSTYTVAWFRQAPGKGLEGVAAIPYTSQHMVYTDSVKGRFTISRDNSKNTVYLQMNSLRAEDTAMYYCATDRRPGTSMLAINGYNRWGQGTTVTVSS

SEQ ID NO: 428 - protein, 125 aa, Artificial Sequence
  AS80533VH6
QVQLVESGGGVVQPGGSLRLSCAASGLSFSTYTVAWFRQAPGKGREGVAAIPYTSQHMVYTDSVKGRFTISRDNSKNTVYLQMNSLRAEDTAMYYCATDRRPGTSMLAINGYNRWGQGTTVTVSS

SEQ ID NO: 429 - protein, 333 aa, Artificial Sequence
  TC-210
MQSGTHWRVLGLCLLSVGVWGQEVQLVESGGGLVQPGGSLRLSCAASGGDWSANFMYWYRQAPGKQRELVARISGRGVVDYVESVKGRFTISRDNSKNTLYLQMNSLRAEDTAVYYCAVASYWGQGTLVTVSSGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 430 - protein, 22 aa, Artificial Sequence
  CD3epsilon signal peptide
MQSGTHWRVLGLCLLSVGVWGQ

SEQ ID NO: 431 - protein, 22 aa, Artificial Sequence
  CD3gamma signal peptide
MEQGKGLAVLILAIILLQGTLA

SEQ ID NO: 432 - protein, 21 aa, Artificial Sequence
  CD3delta signal peptide
MEHSTFLSGLVLATLLSQVSP

SEQ ID NO: 433 - protein, 104 aa, Artificial Sequence
  CD3epsilon extracellular domain
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 434 - protein, 94 aa, Artificial Sequence
  CD3gamma extracellular domain
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATIS

SEQ ID NO: 435 - protein, 84 aa, Artificial Sequence [sequence omitted]

SEQ ID NO: 436 - protein, 26 aa, Artificial Sequence
  CD3epsilon transmembrane domain
VMSVATIVIVDICITGGLLLLVYYWS

SEQ ID NO: 437 - protein, 21 aa, Artificial Sequence
  CD3gamma transmembrane domain
GFLFAEIVSIFVLAVGVYFIA

SEQ ID NO: 438 - protein, 21 aa, Artificial Sequence
  CD3delta transmembrane domain
GIIVTDVIATLLLALGVFCFA

SEQ ID NO: 439 - protein, 55 aa, Artificial Sequence
  CD3epsilon intracelluar domain
KNRKAKAKPVTRGAGAGGRQRGQNKERPPPVPNPDYEPIRKGQRDLYSGLNQRRI

SEQ ID NO: 440 - protein, 45 aa, Artificial Sequence
  CD3gamma intracelluar domain
GQDGVRQSRASDKQTLLPNDQLYQPLKDREDDQYSHLQGNQLRRN

SEQ ID NO: 441 - protein, 45 aa, Artificial Sequence
  CD3delta intracelluar domain
GHETGRLSGAADTQALLRNDQVYQPLRDRDDAQYSHLGGNWARNK

SEQ ID NO: 442 - protein, 243 aa, Artificial Sequence
  FSHbeta 33-53 epsilonTCR
MQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 443 - protein, 218 aa, Artificial Sequence
  FSHbeta 33-53  gammaTCR
MEQGKGLAVLILAIILLQGTLAYTRDLVYKDPARPKIQKTCTFGGGGSGGGGSGGGGSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 444 - protein, 207 aa, Artificial Sequence
  FSHbeta 33-53  deltaTCR
MEHSTFLSGLVLATLLSQVSPYTRDLVYKDPARPKIQKTCTFGGGGSGGGGSGGGGSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 445 - protein, 366 aa, Artificial Sequence
  AS65233VH5 CAR
MALPVTALLLPLALLLHAARPEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 446 - protein, 369 aa, Artificial Sequence
  AS80444VH5 CAR
MALPVTALLLPLALLLHAARPEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 447 - protein, 369 aa, Artificial Sequence
  AS80533VH4 CAR
MALPVTALLLPLALLLHAARPQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 448 - protein, 402 aa, Artificial Sequence
  FSHbeta 33-53 + AS65233VH5 tandem CAR
MALPVTALLLPLALLLHAARPYTRDLVYKDPARPKIQKTCTFGGGGSGGGGSGGGGSEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 449 - protein, 405 aa, Artificial Sequence
  FSHbeta 33-53 + AS80444VH5 tandem CAR
MALPVTALLLPLALLLHAARPYTRDLVYKDPARPKIQKTCTFGGGGSGGGGSGGGGSEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 450 - protein, 405 aa, Artificial Sequence
  FSHbeta 33-53 + AS80533VH4 tandem CAR
MALPVTALLLPLALLLHAARPYTRDLVYKDPARPKIQKTCTFGGGGSGGGGSGGGGSQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 451 - protein, 652 aa, Artificial Sequence
  AS65233VH5 + FSHbeta 33-53 dual CAR
MALPVTALLLPLALLLHAARPEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 452 - protein, 655 aa, Artificial Sequence
  AS80444VH5 + FSHbeta 33-53 dual CAR
MALPVTALLLPLALLLHAARPEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 453 - protein, 655 aa, Artificial Sequence
  AS80533VH4 FSHbeta 33-53 dual CAR
MALPVTALLLPLALLLHAARPQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 454 - protein, 631 aa, Artificial Sequence
  AS65233VH5 CAR + FSHbeta 33-53 epsilonTCR
MALPVTALLLPLALLLHAARPEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 455 - protein, 634 aa, Artificial Sequence
  AS80444VH5 CAR + FSHbeta 33-53 epsilonTCR
MALPVTALLLPLALLLHAARPEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 456 - protein, 634 aa, Artificial Sequence
  AS80533VH4 CAR + FSHbeta 33-53 epsilonTCR
MALPVTALLLPLALLLHAARPQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 457 - protein, 464 aa, Artificial Sequence
  FSHbeta 33-53 epsilonTCR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 458 - protein, 439 aa, Artificial Sequence
  FSHbeta 33-53 gammaTCR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMEQGKGLAVLILAIILLQGTLAYTRDLVYKDPARPKIQKTCTFGGGGSGGGGSGGGGSQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 459 - protein, 428 aa, Artificial Sequence
  FSHbeta 33-53 deltaTCR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMEHSTFLSGLVLATLLSQVSPYTRDLVYKDPARPKIQKTCTFGGGGSGGGGSGGGGSFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 460 - protein, 587 aa, Artificial Sequence
  AS65233VH5 CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 461 - protein, 590 aa, Artificial Sequence
  AS80444VH5 CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 462 - protein, 590 aa, Artificial Sequence
  AS80533VH4 CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 463 - protein, 623 aa, Artificial Sequence
  FSHbeta 33-53 + AS65233VH5 tandem CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPYTRDLVYKDPARPKIQKTCTFGGGGSGGGGSGGGGSEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 464 - protein, 626 aa, Artificial Sequence
  FSHbeta 33-53 + AS80444VH5 tandem CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPYTRDLVYKDPARPKIQKTCTFGGGGSGGGGSGGGGSEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 465 - protein, 626 aa, Artificial Sequence
  FSHbeta 33-53 + AS80533VH4 tandem CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPYTRDLVYKDPARPKIQKTCTFGGGGSGGGGSGGGGSQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 466 - protein, 873 aa, Artificial Sequence
  AS65233VH5 + FSHbeta 33-53 dual CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 467 - protein, 876 aa, Artificial Sequence
  AS80444VH5 + FSHbeta 33-53 dual CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 468 - protein, 876 aa, Artificial Sequence
  AS80533VH4 + FSHbeta 33-53 dual CAR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPYTRDLVYKDPARPKIQKTCTFTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 469 - protein, 852 aa, Artificial Sequence
  AS65233VH5 CAR + FSHbeta 33-53 epsilonTCR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPEVQLVESGGGLVQPGGSLRLSCAASEFTYSMGWFRQAPGKGLEGVAHIYTRGGTTVYADSVKGRFVLSRDNSKNTMYLQMNSLRAEDTAMYYCAARTIFEGSWSSPSSFDFWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 470 - protein, 855 aa, Artificial Sequence
  AS80444VH5 CAR + FSHbeta 33-53 epsilonTCR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPEVQLVESGGGLVQPGGSLRLSCAASGFTFSRNTMGWFRQAPGKGLEGVSAIPYTSTGIVYSDSVGGRFTISRDNSKNTVYLQMNSLRAEDTAMYYCATDRRPGTTMLAVNGYNHWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 471 - protein, 855 aa, Artificial Sequence
  AS80533VH4 CAR + FSHbeta 33-53 epsilonTCR with dnTGF RII
MGRGLLRGLWPLHIVLWTRIASTIPPHVQKSVNNDMIVTDNNGAVKFPQLCKFCDVRFSTCDNQKSCMSNCSITSICEKPQEVCVAVWRKNDENITLETVCHDPKLPYHDFILEDAASPKCIMKEKKKPGETFFMCSCSSDECNDNIIFSEEYNTSNPDLLLVIFQVTGISLLPPLGVAISVIIIFYCYRVNRQQKLSSGSGATNFSLLKQAGDVEENPGPMALPVTALLLPLALLLHAARPQVQLVESGGGVVQPGGSLRLSCAASGLSFSTYTVAWFRQAPGKGLEGVAAIPYTSQHMVYTDSVKGRFTISRDNSKNTLYLQMNSLRAEDTAVYYCATDRRPGTSMLAINGYNRWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMQSGTHWRVLGLCLLSVGVWGQYTRDLVYKDPARPKIQKTCTFGGGGSGGGGSGGGGSDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

The invention claimed is:

1. An antibody or antigen binding fragment that specifically binds mesothelin, comprising:
   a single domain antibody (sdAb) comprising a complementarity determining region 1 (CDR1), a CDR2 and a CDR3 having the polypeptide sequences of:
   a. SEQ ID NOs:66, 134, and 202, respectively;
   b. SEQ ID NOs:67, 135, and 203, respectively; or
   c. SEQ ID NOs:34, 102, and 170, respectively.

2. The antibody or antigen binding fragment of claim 1, wherein
   the single domain antibody comprises an amino acid sequence at least 95% identical to the amino acid sequence selected from the group consisting of SEQ ID NOs: 224, 256, 257 and 420-428.

3. A polynucleotide comprising a first nucleotide sequence encoding a chimeric antigen receptor (CAR), wherein the CAR comprises:
   (a) an extracellular domain comprising an antigen binding fragment comprising:
   a single domain antibody (sdAb) comprising a complementarity determining region 1 (CDR1), a CDR2 and a CDR3 having the polypeptide sequences of:
   (i). SEQ ID NOs: 66, 134, and 202, respectively;
   (ii). SEQ ID NOs: 34, 102, and 170, respectively; or
   (iii). SEQ ID NOs: 67, 135, and 203, respectively;
   (b) a transmembrane domain; and
   (c) an intracellular signaling domain.

4. The polynucleotide of claim 3, wherein the transmembrane domain is selected from the group consisting of a CD8α transmembrane domain, a CD28 transmembrane domain, a CD4 transmembrane domain, a CD3ζ transmembrane domain, a CD2 transmembrane domain, a 4-1BB transmembrane domain, an OX40 transmembrane domain, an ICOS transmembrane domain, a CTLA-4 transmembrane domain, a PD-1 transmembrane domain, a LAG-3 transmembrane domain, a 2B4 transmembrane domain, a BTLA transmembrane domain, and a GMCSFR transmembrane domain;
   the intracellular signaling domain is selected from the group consisting of a signaling domain of CD3ζ, FcRγ, FcRβ, CD3γ, CD3δ, CD3ε, CD5, CD22, CD79a, CD79b, and CD66d;
   wherein the CAR further comprises a co-stimulatory domain selected from the group consisting of a co-stimulatory domain of one or more of CD28, 4-1BB (CD137), CD27, OX40, CD27, CD40, PD-1, ICOS, lymphocyte function-associated antigen-1 (LFA-1), CD2, CD7, LIGHT, NKG2C, B7-H3, TNFRSF9, TNFRSF4, TNFRSF8, CD40LG, ITGB2, KLRC2, TNFRSF18, TNFRSF14, HAVCR1, LGALS9, CD83, and a ligand that specifically binds with CD83.

5. The polynucleotide of claim 3, wherein the CAR comprises the amino acid sequence selected from the group consisting of SEQ ID NOs: 364 and 445-447.

6. The polynucleotide of claim 4, wherein the transmembrane domain is a CD8a transmembrane domain; the intracellular signaling domain is a signaling domain of CD3ζ; and the co-stimulatory domain is a co-stimulatory domain of CD28 or 4-1BB (CD137).

7. The polynucleotide of claim 3, wherein the sdAb comprises a CDR1, a CDR2 and a CDR3 having the polypeptide sequences of SEQ ID NOs: 66, 134, and 202, respectively.

8. The polynucleotide of claim 3, wherein the sdAb comprises a CDR1, a CDR2 and a CDR3 having the polypeptide sequences of SEQ ID NOs: 34, 102, and 170, respectively.

9. The polynucleotide of claim 3, wherein the sdAb comprises a CDR1, a CDR2 and a CDR3 having the polypeptide sequences of SEQ ID NOs: 67, 135, and 203, respectively.

10. The polynucleotide of claim 3, wherein the polynucleotide further comprises a second nucleotide sequence encoding a second chimeric antigen receptor (CAR), wherein the second CAR comprises:
    (a) an extracellular domain comprising a polypeptide that binds specifically to a follicle-stimulating hormone receptor (FSHR);
    (b) a transmembrane domain; and
    (c) an intracellular signaling domain.

11. The polynucleotide of claim 10, wherein the polypeptide that binds specifically to FSHR comprises the amino acid sequence selected from the group consisting of SEQ ID NOs: 319-331, or the polynucleotide comprises the amino acid sequence selected from the group consisting of SEQ ID NOs: 386, and 451-453.

12. The polynucleotide of claim 3, further comprising a second nucleotide sequence encoding a fusion protein comprising, from the N-terminus to the C-terminus, a first polypeptide that binds specifically to a follicle-stimulating hormone receptor (FSHR), and an extracellular domain, a transmembrane domain and an intracellular domain of a CD3 polypeptide selected from the group consisting of a CD3-γ, CD3-δ and CD3-ε chain.

13. The polynucleotide of claim 12, wherein the polynucleotide comprises the amino acid sequence selected from the group consisting of SEQ ID NOs: 454-456.

14. The polynucleotide of claim 3, further comprising a nucleotide sequence encoding a dominant negative form of transforming growth factor β (TGF-β) receptor.

15. The polynucleotide of claim 10, further comprising a third nucleotide sequence encoding a dominant negative form of transforming growth factor β (TGF-β) receptor.

16. The polynucleotide of claim 12, further comprising a third nucleotide sequence encoding a dominant negative form of transforming growth factor β (TGF-β) receptor.

17. The isolated polynucleotide of claim 14, wherein the dominant negative form of transforming growth factor p (TGF-3) receptor comprises the amino acid sequence of SEQ ID NO: 347.

18. The polynucleotide of claim 17, wherein the polynucleotide comprises the amino acid sequence selected from the group consisting of SEQ ID NOs: 396, 406, 416, and 460-471.

19. An engineered immune cell expressing the CAR encoded by the polynucleotide of claim 3.

20. The engineered immune cell of claim 19, wherein the engineered immune cell is selected from the group consisting of a cytotoxic T cell, a helper T cell, a natural killer T cell, a γδT cell, and a NK cell.

21. A pharmaceutical composition, comprising the engineered immune cell of claim 19 and a pharmaceutically acceptable carrier.

22. A polynucleotide comprising a nucleotide sequence encoding a chimeric antigen receptor (CAR), wherein the CAR comprises:

(a) an extracellular domain comprising a first polypeptide that binds specifically to a follicle-stimulating hormone receptor (FSHR) and an antigen binding fragment comprising:

a single domain antibody (sdAb) comprising a complementarity determining region 1 (CDR1), a CDR2 and a CDR3 having the polypeptide sequences of:

(i). SEQ ID NOs: 66, 134, and 202, respectively;

(ii). SEQ ID NOs: 34, 102, and 170, respectively; or (iii). SEQ ID NOs: 67, 135, and 203, respectively;

(b) a transmembrane domain; and (c) an intracellular signaling domain.

23. The polynucleotide of claim 22, wherein the extracellular domain of the CAR comprises the amino acid sequence selected from the group consisting of SEQ ID NOs: 354, 376, and 448-450.

24. The polynucleotide of claim 22, further comprising a nucleotide sequence encoding a dominant negative form of transforming growth factor β (TGF-β) receptor.

* * * * *

UNITED STATES PATENT AND TRADEMARK OFFICE
CERTIFICATE OF CORRECTION

| | | |
|---|---|---|
| PATENT NO. | : 11,932,698 B2 | Page 1 of 1 |
| APPLICATION NO. | : 17/270970 | |
| DATED | : March 19, 2024 | |
| INVENTOR(S) | : Dai et al. | |

It is certified that error appears in the above-identified patent and that said Letters Patent is hereby corrected as shown below:

On the Title Page

Item (30) Foreign Application Priority Data, Line 1, please delete "(WO)" and insert therefor -- (CN) --;

Item (30) Foreign Application Priority Data, Line 2, please delete "(WO)" and insert therefor -- (CN) --;

In the Claims

Column 148, Line 18, Claim 6, please delete "CD8a" and insert therefor -- CD8α --;

Column 149, Line 4, Claim 17, please delete "The isolated" and insert therefor -- The --;

Column 149, Lines 5-6, Claim 17, please delete "factor p (TGF-3)" and insert therefor -- factor β (TGF-β) --.

Signed and Sealed this
Twenty-second Day of April, 2025

Coke Morgan Stewart
*Acting Director of the United States Patent and Trademark Office*